(12) United States Patent
Freier

(10) Patent No.: US 12,180,479 B2
(45) Date of Patent: Dec. 31, 2024

(54) COMPOUNDS AND METHODS FOR MODULATING ATXN1

(71) Applicant: Ionis Pharmaceuticals, Inc., Carlsbad, CA (US)

(72) Inventor: Susan M. Freier, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 18/047,973

(22) Filed: Oct. 19, 2022

(65) Prior Publication Data

US 2024/0067962 A1 Feb. 29, 2024

Related U.S. Application Data

(63) Continuation of application No. 17/751,450, filed on May 23, 2022, now Pat. No. 11,542,504, which is a continuation of application No. PCT/US2021/030203, filed on Apr. 30, 2021.

(60) Provisional application No. 63/019,089, filed on May 1, 2020.

(51) Int. Cl.
| | |
|---|---|
| C07H 21/04 | (2006.01) |
| A61K 31/712 | (2006.01) |
| A61K 35/30 | (2015.01) |
| A61K 47/02 | (2006.01) |
| A61P 25/00 | (2006.01) |
| C12N 15/113 | (2010.01) |

(52) U.S. Cl.
CPC .......... *C12N 15/113* (2013.01); *A61K 31/712* (2013.01); *A61K 35/30* (2013.01); *A61K 47/02* (2013.01); *A61P 25/00* (2018.01); *C12N 2310/11* (2013.01); *C12N 2310/315* (2013.01); *C12N 2310/3231* (2013.01); *C12N 2310/3341* (2013.01); *C12N 2310/341* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |

(Continued)

FOREIGN PATENT DOCUMENTS

| | | |
|---|---|---|
| WO | WO 2002/058626 | 8/2002 |
| WO | WO 2004/044123 | 5/2004 |

(Continued)

OTHER PUBLICATIONS

Branch et al., "A good antisense molecule is hard to find," TIBS (1998) 23:45-50.

(Continued)

*Primary Examiner* — Kimberly Chong

(74) *Attorney, Agent, or Firm* — McNeill Baur PLLC

(57) ABSTRACT

Provided are compounds, methods, and pharmaceutical compositions for reducing the amount or activity of ATXN1 RNA in a cell or subject, and in certain instances reducing the amount of ATXN1 in a cell or subject. Such compounds, methods, and pharmaceutical compositions are useful to ameliorate at least one symptom or hallmark of a neurodegenerative disease. Such symptoms and hallmarks include gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within 10-15 years of symptom onset. Such neurodegenerative diseases include Spinocerebellar ataxia type 1.

30 Claims, No Drawings

Specification includes a Sequence Listing.

(56) References Cited

U.S. PATENT DOCUMENTS

| | | |
|---|---|---|
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,770,748 B2 | 8/2004 | Imanishi et al. |
| 7,015,315 B1 | 3/2006 | Cook et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,691,997 B2 | 4/2010 | Khvorova et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 11,542,504 B2 | 1/2023 | Zhou |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2005/0130923 A1 | 6/2005 | Bhat et al. |
| 2005/0244851 A1 | 11/2005 | Blume et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |
| 2010/0190837 A1 | 7/2010 | Migawa et al. |
| 2010/0197762 A1 | 8/2010 | Swayze et al. |
| 2011/0111491 A1 | 5/2011 | Davidson et al. |
| 2013/0130378 A1 | 5/2013 | Manoharan et al. |

(56) References Cited

U.S. PATENT DOCUMENTS

| | | |
|---|---|---|
| 2014/0107330 A1 | 4/2014 | Freier et al. |
| 2015/0018540 A1 | 1/2015 | Prakash et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2019/0330639 A1 | 10/2019 | Brown et al. |
| 2022/0290146 A1 | 9/2022 | Zhou |

FOREIGN PATENT DOCUMENTS

| | | |
|---|---|---|
| WO | WO 2004/047872 | 6/2004 |
| WO | WO 2012/012467 | 1/2012 |
| WO | WO 2018/154439 | 8/2018 |
| WO | WO 2021/222768 | 11/2021 |

OTHER PUBLICATIONS

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Crooke et al., "Basic Principles of Antisense Therapeutics" Antisense Research and Application (1998) Chapter 1:1-50.

Crooke, St., et al., "Antisense Drug Technology" Second Edition, CRC Press (2008) Chapters 1-28.

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Evers et al., "Targeting Several CAG Expansion Diseases by a Single Antisense Oligonucleotide" PLOS One (2011) 6: e24308.

Friedrich et al., "Antisense oligonucleotide-mediated ataxin-1 reduction prolongs survival in SCA1 mice and reveals disease-associated transcriptome profiles" JCI Insight (2018) 3: e123193.

Friedrich et al., "Antisense Oligonucleotides as a Potential Therapeutic for SCA1" Presentation for 6th Ataxia Investigators Meeting (AIM 2016) Orlando, FL (Mar. 29-Apr. 1).

Gao et al., "Antisense RNA Sequences Modulating the Ataxin-1 Message: Molecular Model of Gene Therapy for Spinocerebellar Ataxia Type 1, a Dominant-Acting Unstable Trinucleotide Repeat Disease" Cell Transplantation (2008) 17: 723-734.

Gautschi et al., "Activity of a novel bcl-2/bcl-xLbispecific antisense oligonucleotide against tumors of diverse histologic origins" J. Natl. Cancer Inst. (2001) 93:463-471.

International Search Report for PCT/US21/030203 dated Oct. 27, 2021.

Ju et al., "Beyond the glutamine expansion: influence of post-translational modifications of ataxin-1 in the pathogenesis of spinocerebellar ataxia type 1" Mol Neurobiol (2014) 50: 866-874.

Keiser et al., "RNAi Prevents and Reverses Phenotypes Induced by Mutant Human Ataxin-1" Ann Neurol (2016) 80: 754-765.

Keiser et al., "RNAi of overexpression: Alternative therapies for Spinocerebellar Ataxia Type 1" Neurobiology of Disease (2013) 56: 6-13.

Maher et al., "Comparative hybrid arrest by tandem antisense oligodeoxyribonucleotides or oligodeoxyribonucleoside methylphosphonates in a cell-free system" Nucl. Acid. Res. (1988) 16(8): 3341-3358.

O'Callaghan et al. "Antisense Oligonucleotide Therapeutic Approach for Suppression of Ataxin-1 Expression: A Safety Assessment" Mol Ther Nucl Acids (2020) 21: 1006-1016.

Ortiz et al., "Spinocerebellar Ataxia Type 1: Molecular Mechanisms of Neurodegeneration and Preclinical Studies" Adv Exp Med Biol (2018) 1049: 135-145.

Reynolds et al., "Rational siRNA design for RNA interference" Nature Biotechnology (2004) 22(3):326-330.

Sanghvi et al., "Heterocyclic Base Modifications in Nucleic Acids and Their Applications in Antisense Oligonucleotides" Antisense Research and Applications (1993) pp. 273-288.

Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.

Woolf et al., "Specificity of antisense oligonucleotides in vivo" PNAS (1992) 89: 7305-7309.

COMPOUNDS AND METHODS FOR MODULATING ATXN1

SEQUENCE LISTING

The present application is being filed along with a Sequence Listing in electronic format. The Sequence Listing is provided as a file entitled BIOL0355USC2SEQ.xml, created on Aug. 22, 2022, which is 3,707 KB in size. The information in the electronic format of the sequence listing is incorporated herein by reference in its entirety.

FIELD

Provided are compounds, methods, and pharmaceutical compositions for reducing the amount or activity of ATXN1 RNA in a cell or subject, and in certain instances reducing the amount of ATXN1 protein in a cell or subject. Such compounds, methods, and pharmaceutical compositions are useful to ameliorate at least one symptom or hallmark of a neurodegenerative disease. Such symptoms and hallmarks include gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within 10-15 years of symptom onset. Such neurodegenerative diseases include Spinocerebellar ataxia type 1.

BACKGROUND

Spinocerebellar ataxia type 1 (SCA1) is a progressive and fatal neurodegenerative disorder that affects 1-2/100,000 individuals worldwide. SCA1 is caused by an expanded CAG repeat in the coding region of gene encoding Ataxin-1, ATXN1. Accumulation of mutant Ataxin-1 protein leads to the degeneration of Purkinje cells and brainstem nuclei. Symptoms and hallmarks of SCA1 include gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within years of symptom onset (see, e.g., Ju, H., Kokubu, H., and Lim, J., *Mol. Neurobiol.* 50:866-874, 2014; Ortiz, J. P., Orr, H. T., in Polyglutamine Disorders, Nóbrega, C. and Almeida, L., eds., *Advances in Exp. Med. And Biol.*, 1049: 135-145, 2018).

There are no specific therapies for SCA1, with current treatments being limited to supportive treatments for individual symptoms.

Currently there is a lack of acceptable options for treating neurodegenerative diseases such as SCA1. It is therefore an object herein to provide compounds, methods, and pharmaceutical compositions for the treatment of such diseases.

SUMMARY OF THE INVENTION

Provided herein are compounds, methods and pharmaceutical compositions for reducing the amount or activity of ATXN1 RNA, and in certain embodiments reducing the expression of ATXN1 protein in a cell or subject. In certain embodiments, the subject has a neurodegenerative disease. In certain embodiments, the subject has Spinocerebellar ataxia type 1 (SCA1). In certain embodiments, compounds useful for reducing the amount or activity of ATXN1 RNA are oligomeric compounds. In certain embodiments, compounds useful for reducing the amount or activity of ATXN1 RNA are modified oligonucleotides. In certain embodiments, compounds useful for decreasing expression of ATXN1 protein are oligomeric compounds. In certain embodiments, compounds useful for decreasing expression of ATXN1 protein are modified oligonucleotides.

Also provided are methods useful for ameliorating at least one symptom or hallmark of a neurodegenerative disease. In certain embodiments, the neurodegenerative disease is Spinocerebellar ataxia type 1. In certain embodiments, the symptom or hallmark includes gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within years of symptom onset.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, treatises, and GenBank, ENSEMBL, and NCBI reference sequence records, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyfuranosyl sugar moiety. In certain embodiments, a 2'-deoxynucleoside is a 2'-β-D-deoxynucleoside and comprises a 2'-β-D-deoxyribosyl sugar moiety, which has the 13-D ribosyl configuration as found in naturally occurring deoxyribonucleic acids (DNA). In certain embodiments, a 2'-deoxynucleoside may comprise a modified nucleobase or may comprise an RNA nucleobase (uracil).

As used herein, "2'-MOE" means a 2'-OCH$_2$CH$_2$OCH$_3$ group in place of the 2'-OH group of a furanosyl sugar moiety. A "2'-MOE sugar moiety" means a sugar moiety with a 2'-OCH$_2$CH$_2$OCH$_3$ group in place of the 2'-OH group of a furanosyl sugar moiety. Unless otherwise indicated, a 2'-MOE sugar moiety is in the 0-D-ribosyl configuration. "MOE" means O-methoxyethyl.

As used herein, "2'-MOE nucleoside" means a nucleoside comprising a 2'-MOE sugar moiety.

As used herein, "2'-OMe" means a 2'-OCH$_3$ group in place of the 2'-OH group of a furanosyl sugar moiety. A "2'-O-methyl sugar moiety" or "2'-OMe sugar moiety" means a sugar moiety with a 2'-OCH$_3$ group in place of the 2'-OH group of a furanosyl sugar moiety. Unless otherwise indicated, a 2'-OMe sugar moiety is in the 0-D-ribosyl configuration.

As used herein, "2'-OMe nucleoside" means a nucleoside comprising a 2'-OMe sugar moiety.

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methyl cytosine" means a cytosine modified with a methyl group attached to the 5 position. A 5-methyl cytosine is a modified nucleobase.

As used herein, "administering" means providing a pharmaceutical agent to a subject.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within years of symptom onset.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms of the first ring thereby forming a bicyclic structure. In certain embodiments, the first ring of the bicyclic sugar moiety is a furanosyl moiety. In certain embodiments, the furanosyl sugar moiety is a ribosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more portions thereof and the nucleobases of another nucleic acid or one or more portions thereof are capable of hydrogen bonding with one another when the nucleobase sequence of the oligonucleotide and the other nucleic acid are aligned in opposing directions. As used herein, complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or target nucleic acids need not have nucleobase complementarity at each nucleoside. Rather, some mismatches are tolerated. As used herein, "fully complementary" or "100% complementary" in reference to an oligonucleotide, or portion thereof, means that the oligonucleotide, or a portion thereof, is complementary to another oligonucleotide or target nucleic acid at each nucleobase of the shorter of the two oligonucleotides, or at each nucleoside if the oligonucleotides are the same length.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "cEt" means a 4' to 2' bridge in place of the 2'OH-group of a ribosyl sugar moiety, wherein the bridge has the formula of 4'-CH(CH$_3$)—O-2', and wherein the methyl group of the bridge is in the S configuration. A "cEt sugar moiety" is a bicyclic sugar moiety with a 4' to 2' bridge in place of the 2'OH-group of a ribosyl sugar moiety, wherein the bridge has the formula of 4'-CH(CH$_3$)—O-2', and wherein the methyl group of the bridge is in the S configuration. "cEt" means constrained ethyl.

As used herein, "cEt nucleoside" means a nucleoside comprising a cEt sugar moiety. As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "chirally controlled" in reference to an internucleoside linkage means chirality at that linkage is enriched for a particular stereochemical configuration.

As used herein, "deoxy region" means a region of 5-12 contiguous nucleotides, wherein at least 70% of the nucleosides are 2'-β-D-deoxynucleosides. In certain embodiments, each nucleoside is selected from a 2'-β-D-deoxynucleoside, a bicyclic nucleoside, and a 2'-substituted nucleoside. In certain embodiments, a deoxy region supports RNase H activity. In certain embodiments, a deoxy region is the gap or internal region of a gapmer.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." The internal region is a deoxy region. The positions of the internal region or gap refer to the order of the nucleosides of the internal region and are counted starting from the 5'-end of the internal region. Unless otherwise indicated, "gapmer" refers to a sugar motif. In certain embodiments, each nucleoside of the gap is a 2'-β-D-deoxynucleoside. In certain embodiments, the gap comprises one 2'-substituted nucleoside at position 1, 2, 3, 4, or 5 of the gap, and the remainder of the nucleosides of the gap are 2'-β-D-deoxynucleosides. As used herein, the term "MOE gapmer" indicates a gapmer having a gap comprising 2'-β-D-deoxynucleosides and wings comprising 2'-MOE nucleosides. As used herein, the term "mixed wing gapmer" indicates a gapmer having wings comprising modified nucleosides comprising at least two different sugar modifications. Unless otherwise indicated, a gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid that is amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, "internucleoside linkage" means the covalent linkage between contiguous nucleosides in an oligonucleotide. As used herein, "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "motif" means the pattern of unmodified and/or modified sugar moieties, nucleobases, and/or internucleoside linkages, in an oligonucleotide.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a target nucleic acid or oligonucleotide independent of any sugar or internucleoside linkage modification.

As used herein, "nucleoside" means a compound or a fragment of a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to a subject. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein, "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein, "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein, "prodrug" means a therapeutic agent in a form outside the body that is converted to a different form within a subject or cells thereof. Typically, conversion of a prodrug within the subject is facilitated by the action of an enzymes (e.g., endogenous or viral enzyme) or chemicals present in cells or tissues and/or by physiologic conditions.

As used herein, "reducing the amount or activity" refers to a reduction or blockade of the transcriptional expression or activity relative to the transcriptional expression or activity in an untreated or control sample and does not necessarily indicate a total elimination of transcriptional expression or activity.

As used herein, "RNA" means an RNA transcript and includes pre-mRNA and mature mRNA unless otherwise specified.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard in vitro assay" or "standard cell assay" means the assay described in Example 1 and reasonable variations thereof.

As used herein, "standard in vivo assay" means the assay described in Example 6 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "subject" means a human or non-human animal.

As used herein, "sugar moiety" means an unmodified sugar moiety or a modified sugar moiety. As used herein, "unmodified sugar moiety" means a 2'-OH(H) 0-D-ribosyl moiety, as found in RNA (an "unmodified RNA sugar moiety"), or a 2'-H(H) 0-D-deoxyribosyl sugar moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "symptom or hallmark" means any physical feature or test result that indicates the existence or extent of a disease or disorder. In certain embodiments, a symptom is apparent to a subject or to a medical professional examining or testing said subject. In certain embodiments, a hallmark is apparent upon invasive diagnostic testing, including, but not limited to, post-mortem tests. In certain embodiments, a hallmark is apparent on a brain MRI scan.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to a subject. For example, a therapeutically effective amount improves a symptom or hallmark of a disease.

Certain Embodiments

The present disclosure provides the following non-limiting numbered embodiments:

Embodiment 1. An oligomeric compound comprising a modified oligonucleotide consisting of 12 to 30 linked nucleosides wherein the nucleobase sequence of the modified oligonucleotide is at least 90% complementary to an equal length portion of an ATXN1 nucleic acid, and wherein the modified oligonucleotide comprises at least one modification selected from a modified sugar moiety and a modified internucleoside linkage.

Embodiment 2. An oligomeric compound comprising a modified oligonucleotide consisting of 12 to 30 linked nucleosides and having a nucleobase sequence comprising at least 12, 13, 14, 15, 16, 17, 18, 19, or 20 contiguous nucleobases of any of SEQ ID NOs: 22-3624 or 3655.

Embodiment 3. An oligomeric compound comprising a modified oligonucleotide consisting of 12 to 30 linked nucleosides and having a nucleobase sequence comprising at least 12, 13, 14, 15, 16, or 17 contiguous nucleobases of any of SEQ ID NOs: 3625-3654 or 3656-3669.

Embodiment 4. An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, at least 17, at least 18, at least 19, or at least 20 contiguous nucleobases complementary to:

an equal length portion of nucleobases 5472-5552 of SEQ ID NO: 1;

an equal length portion of nucleobases 5906-6005 of SEQ ID NO: 1;

an equal length portion of nucleobases 7868-7911 of SEQ ID NO: 1;

an equal length portion of nucleobases 8481-8514 of SEQ ID NO: 1; or an equal length portion of nucleobases 446679-446706 of SEQ ID NO: 2.

Embodiment 5. An oligomeric compound comprising a modified oligonucleotide consisting of 12 to 30 linked nucleosides and having a nucleobase sequence comprising at least 8, at least 9, at least 10, at least 11, at least 12, at least 13, at least 14, at least 15, at least 16, or at least 17 contiguous nucleobases of a sequence selected from:

SEQ ID NOs: 196, 274, 352, 430, 508, 2578, 2655, 2732, 2809, 2886, 2963, 3121, 3122, 3190, 3191, 3192, 3262, 3330, 3331, 3332, 3401, 3402, 3575, 3577, 3620, 3624, 3638-3640, 3653-3655, 3662, 3665, 3669;

SEQ ID Nos: 42, 120, 198, 276, 509, 587, 2502, 2579, 2656, 2733, 2810, 2887, 2964, 3585, 3588-3590, 3615, 3618, 3622, 3657, 3660, 3661, 3663, 3664, 3666-3668;

SEQ ID Nos: 48, 126, 2044, 2121;

SEQ ID Nos: 128, 206, 284, 1045, 1122, 1199, and 1276; or

SEQ ID Nos: 2475, 2552, 2629, 2706, 2783, 3627-3630, 3644.

Embodiment 6. The oligomeric compound of any of embodiments 1-5, wherein the modified oligonucleotide has a nucleobase sequence that is at least 80%, 85%, 90%, 95%, or 100% complementary to the nucleobase sequence of SEQ ID NO: 1, SEQ ID NO: 2, SEQ ID NO: 3, SEQ ID NO: 4, SEQ ID NO: 5, or SEQ ID NO: 6 when measured across the entire nucleobase sequence of the modified oligonucleotide.

Embodiment 7. The oligomeric compound of any of embodiments 1-6, wherein the modified oligonucleotide comprises at least one modified nucleoside.

Embodiment 8. The oligomeric compound of embodiment 7, wherein the modified oligonucleotide comprises at least one modified nucleoside comprising a modified sugar moiety.

Embodiment 9. The oligomeric compound of embodiment 8, wherein the modified oligonucleotide comprises at least one modified nucleoside comprising a bicyclic sugar moiety.

Embodiment 10. The oligomeric compound of embodiment 9, wherein the modified oligonucleotide comprises at least one modified nucleoside comprising a bicyclic sugar moiety having a 2'-4' bridge, wherein the 2'-4' bridge is selected from —O—CH$_2$—; and —O—CH(CH$_3$)—.

Embodiment 11. The oligomeric compound of any of embodiments 7-10, wherein the modified oligonucleotide comprises at least one modified nucleoside comprising a non-bicyclic modified sugar moiety.

Embodiment 12. The oligomeric compound of embodiment 11, wherein the non-bicyclic modified sugar moiety is a 2'-MOE sugar moiety or 2'-OMe modified sugar moiety.

Embodiment 13. The oligomeric compound of any of embodiments 7-8, wherein the modified oligonucleotide comprises at least one modified nucleoside comprising a sugar surrogate.

Embodiment 14. The oligomeric compound of embodiment 13, wherein the modified oligonucleotide comprises at least one modified nucleoside comprising a sugar surrogate selected from morpholino and PNA.

Embodiment 15. The oligomeric compound of any of embodiments 1-8 or 11-14, wherein the modified oligonucleotide does not comprise a bicyclic sugar moiety.

Embodiment 16. The oligomeric compound of any of embodiments 1-15, wherein the modified oligonucleotide is a gapmer.

Embodiment 17. The oligomeric compound of any of embodiments 1-16, wherein the modified oligonucleotide has a sugar motif comprising:

a 5'-region consisting of 1-6 linked 5'-region nucleosides;

a central region consisting of 6-10 linked central region nucleosides; and a 3'-region consisting of 1-6 linked 3'-region nucleosides; wherein each of the 5'-region nucleosides and each of the 3'-region nucleosides comprises a modified sugar moiety and each of the central region nucleosides comprises a 2'-deoxyfuranosyl sugar moiety.

Embodiment 18. The oligomeric compound of embodiment 17, wherein the modified oligonucleotide has a sugar motif comprising:

a 5'-region consisting of 6 linked 5'-region nucleosides;

a central region consisting of 10 linked central region nucleosides; and a 3'-region consisting of 4 linked 3'-region nucleosides; wherein each of the 5'-region nucleosides and each of the 3'-region nucleosides is a 2'-MOE nucleoside, and each of the central region nucleosides is a 2'-β-D-deoxynucleoside.

Embodiment 19. The oligomeric compound of embodiment 17, wherein the modified oligonucleotide has a sugar motif comprising:

a 5'-region consisting of 5 linked 5'-region nucleosides;

a central region consisting of 10 linked central region nucleosides; and a 3'-region consisting of 5 linked 3'-region nucleosides; wherein each of the 5'-region nucleosides and each of the 3'-region nucleosides is a 2'-MOE nucleoside, and each of the central region nucleosides is a 2'-β-D-deoxynucleoside.

Embodiment 20. The oligomeric compound of embodiment 17, wherein the modified oligonucleotide has a 5'-region consisting of 5 linked 5'-region nucleosides;

a central region consisting of 8 linked central region nucleosides; and a 3'-region consisting of 4 linked 3'-region nucleosides; wherein each of the 5'-region nucleosides and each of the 3'-region nucleosides comprises a is a 2'-MOE nucleoside, and each of the central region nucleosides is a 2'-β-D-deoxynucleoside.

Embodiment 21. The oligomeric compound of embodiment 17, wherein the modified oligonucleotide has a 5'-region consisting of 5 linked 5'-region nucleosides;

a central region consisting of 8 linked central region nucleosides; and a 3'-region consisting of 4 linked 3'-region nucleosides; wherein each of the 5'-region nucleosides comprises a 2'-MOE sugar moiety, each of the 3'-region nucleosides is selected from a 2'-MOE nucleoside and a cEt nucleoside, and each of the central region nucleosides comprises a 2'-β-D-deoxynucleoside.

Embodiment 22. The oligomeric compound of any of embodiments 1-16, wherein the modified oligonucleotide has a sugar motif comprising:

a 5'-region consisting of 1-6 linked 5'-region nucleosides;

a central region consisting of 6-10 linked central region nucleosides; and a 3'-region consisting of 1-6 linked 3'-region nucleosides; wherein each of the 5'-region nucleosides and each of the 3'-region nucleosides comprises a modified sugar moiety, and the central region has the following formula:

(N$d$)(N$x$)(N$d$)$n$ wherein Nx is a 2'-OMe nucleoside and each Nd is a 2'-O-D-deoxynucleoside;

and n is from 6 to 8.

Embodiment 23. The oligomeric compound of any of embodiments 1-16, wherein the modified oligonucleotide has a sugar motif comprising:

a 5'-region consisting of 5 linked 5'-region nucleosides;

a central region consisting of 6-10 linked central region nucleosides; and a 3'-region consisting of 4 linked 3'-region nucleosides; wherein each of the 5'-region nucleosides and each of the 3'-region nucleosides is selected from a 2'-MOE nucleoside and a cEt nucleoside, and the central region has the following formula:

(N$d$)(N$x$)(N$d$)$n$ wherein Nx is a 2'-OMe nucleoside and each Nd is a 2'-O-D-deoxynucleoside;

and n is 7.

Embodiment 24. The oligomeric compound of any of embodiments 1-23, wherein the modified oligonucleotide comprises at least one modified internucleoside linkage.

Embodiment 25. The oligomeric compound of embodiment 24, wherein each internucleoside linkage of the modified oligonucleotide is a modified internucleoside linkage.

Embodiment 26. The oligomeric compound of embodiment 24 or 25 wherein the modified internucleoside linkage is a phosphorothioate internucleoside linkage.

Embodiment 27. The oligomeric compound of embodiment 24 or 26 wherein the modified oligonucleotide comprises at least one phosphodiester internucleoside linkage.

Embodiment 28. The oligomeric compound of any of embodiments 24, 26, or 27, wherein each internucleoside linkage is independently selected from a phosphodiester internucleoside linkage or a phosphorothioate internucleoside linkage.

Embodiment 29. The oligomeric compound of embodiments 1-24 or 26-28, wherein the modified oligonucleotide has an internucleoside linkage motif selected from among: sooossssssssssssooss, sssosssssssssssssosss, sssosssssssssssoss, or sooooosssssssssssoss; wherein, s=a phosphorothioate internucleoside linkage and o=a phosphodiester internucleoside linkage.

Embodiment 30. The oligomeric compound of any of embodiments 1-29, wherein the modified oligonucleotide comprises a modified nucleobase.

Embodiment 31. The oligomeric compound of embodiment 30, wherein the modified nucleobase is a 5-methyl cytosine.

Embodiment 32. The oligomeric compound of any of embodiments 1-31, wherein the modified oligonucleotide consists of 12-30, 12-22, 12-20, 14-18, 16-18, 14-20, 15-17, 15-25, 16-20, or 17-20 linked nucleosides.

Embodiment 33. The oligomeric compound of any of embodiments 1-2, 4-19, 22 or 24-31, wherein the modified oligonucleotide consists of 18-22 or 18-20 linked nucleosides.

Embodiment 34. The oligomeric compound of any of embodiments 1-17 or 20-32, wherein the modified oligonucleotide consists of 17 linked nucleosides.

Embodiment 35. The oligomeric compound of any of embodiments 1-2, 4-19, 22 or 24-31, wherein the modified oligonucleotide consists of 20 linked nucleosides.

Embodiment 36. The oligomeric compound of any of embodiments 1-35, consisting of the modified oligonucleotide.

Embodiment 37. The oligomeric compound of any of embodiments 1-35, comprising a conjugate group comprising a conjugate moiety and a conjugate linker.

Embodiment 38. The oligomeric compound of embodiment 37, wherein the conjugate linker consists of a single bond.

Embodiment 39. The oligomeric compound of embodiment 37, wherein the conjugate linker is cleavable.

Embodiment 40. The oligomeric compound of embodiment 37, wherein the conjugate linker comprises 1-3 linker-nucleosides.

Embodiment 41. The oligomeric compound of any of embodiments 37-40, wherein the conjugate group is attached to the modified oligonucleotide at the 5'-end of the modified oligonucleotide.

Embodiment 42. The oligomeric compound of any of embodiments 37-40, wherein the conjugate group is attached to the modified oligonucleotide at the 3'-end of the modified oligonucleotide.

Embodiment 43. The oligomeric compound of any of embodiments 1-35 or 37-42, comprising a terminal group.

Embodiment 44. The oligomeric compound of any of embodiments 1-43 wherein the oligomeric compound is a singled-stranded oligomeric compound.

Embodiment 45. The oligomeric compound of any of embodiments 1-39 or 41-42, wherein the oligomeric compound does not comprise linker-nucleosides.

Embodiment 46. An oligomeric duplex comprising an oligomeric compound of any of embodiments 1-43 or 45.

Embodiment 47. An antisense compound comprising or consisting of an oligomeric compound of any of embodiments 1-45 or an oligomeric duplex of embodiment 46.

Embodiment 48. A pharmaceutical composition comprising an oligomeric compound of any of embodiments 1-45 or an oligomeric duplex of embodiment 46 and a pharmaceutically acceptable carrier or diluent.

Embodiment 49. The pharmaceutical composition of embodiment 48, wherein the pharmaceutically acceptable diluent is artificial cerebral spinal fluid.

Embodiment 50. The pharmaceutical composition of embodiment 49, wherein the pharmaceutical composition consists essentially of the modified oligonucleotide and artificial cerebral spinal fluid.

Embodiment 51. A method comprising administering to a subject a pharmaceutical composition of any of embodiments 48-50.

Embodiment 52. A method of treating a disease associated with ATXN1 comprising administering to an individual having or at risk for developing a disease associated with ATXN1 a therapeutically effective amount of a pharmaceutical composition according to any of embodiments 48-50; and thereby treating the disease associated with ATXN1.

Embodiment 53. The method of embodiment 52, wherein the ATXN1-associated disease is Spinocerebellar ataxia type 1.

Embodiment 54. The method of any of embodiments 51-52, wherein at least one symptom or hallmark of the ATXN1-associated disease is ameliorated.

Embodiment 55. The method of embodiment 54, wherein the symptom or hallmark is gait or limb ataxia, cognitive impairments, difficulty with speaking or swallowing, atrophy of the cerebellum and/or brainstem in magnetic resonance imaging (MRI), neurochemical abnormalities in the cerebellum and/or brainstem detected via magnetic resonance spectroscopy (MRS), or death within 10-15 years of symptom onset.

Embodiment 56. The method of any of embodiments 51-53, wherein ATXN1 levels in the individual are reduced.

Embodiment 57. A modified oligonucleotide according to the following chemical structure:

(SEQ ID NO: 3671)

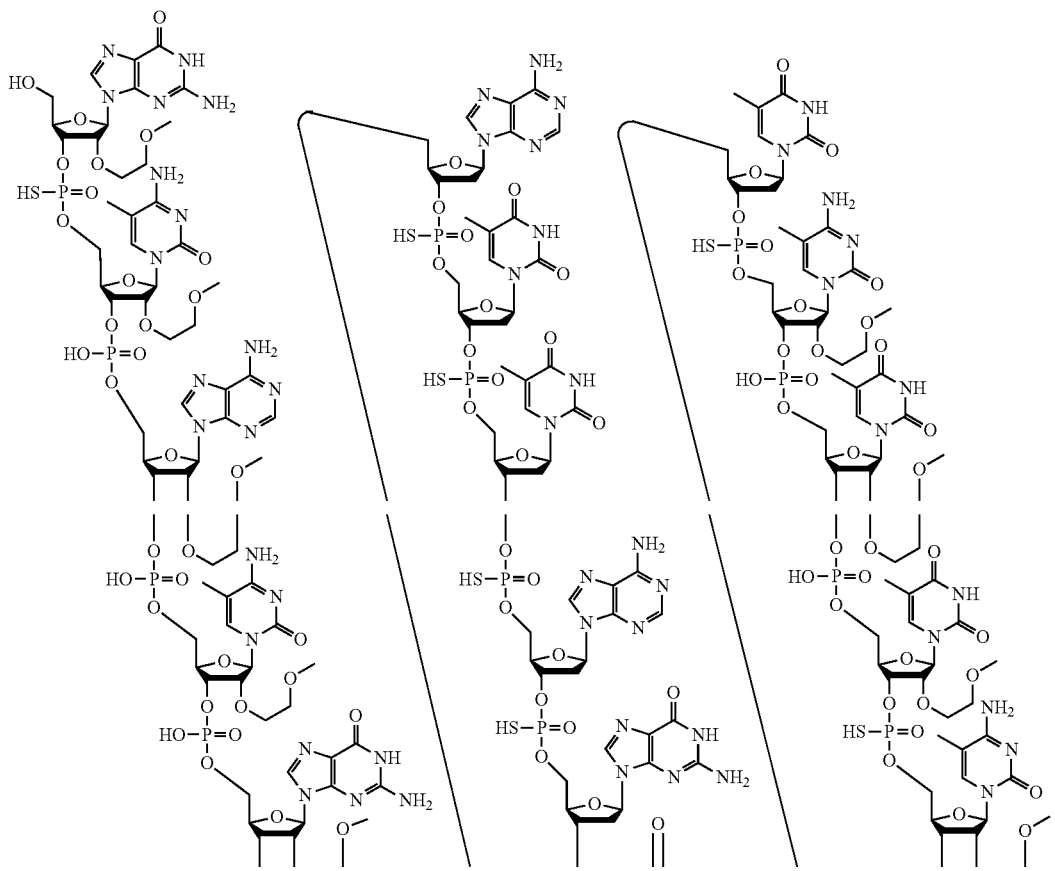

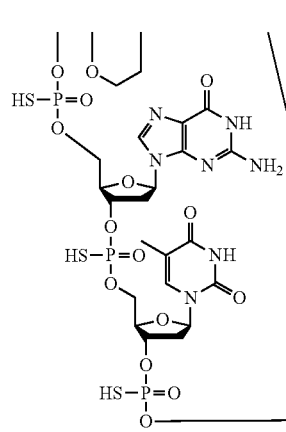
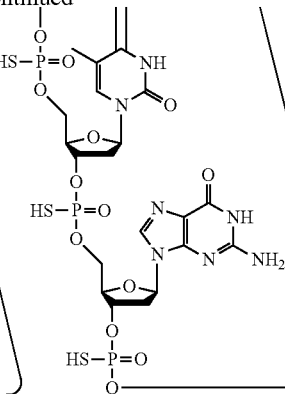
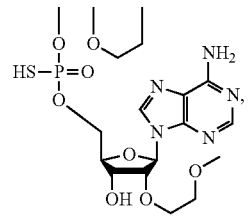
or a salt thereof.
Embodiment 58. A modified oligonucleotide according to the following chemical structure:
(SEQ ID NO: 3672)
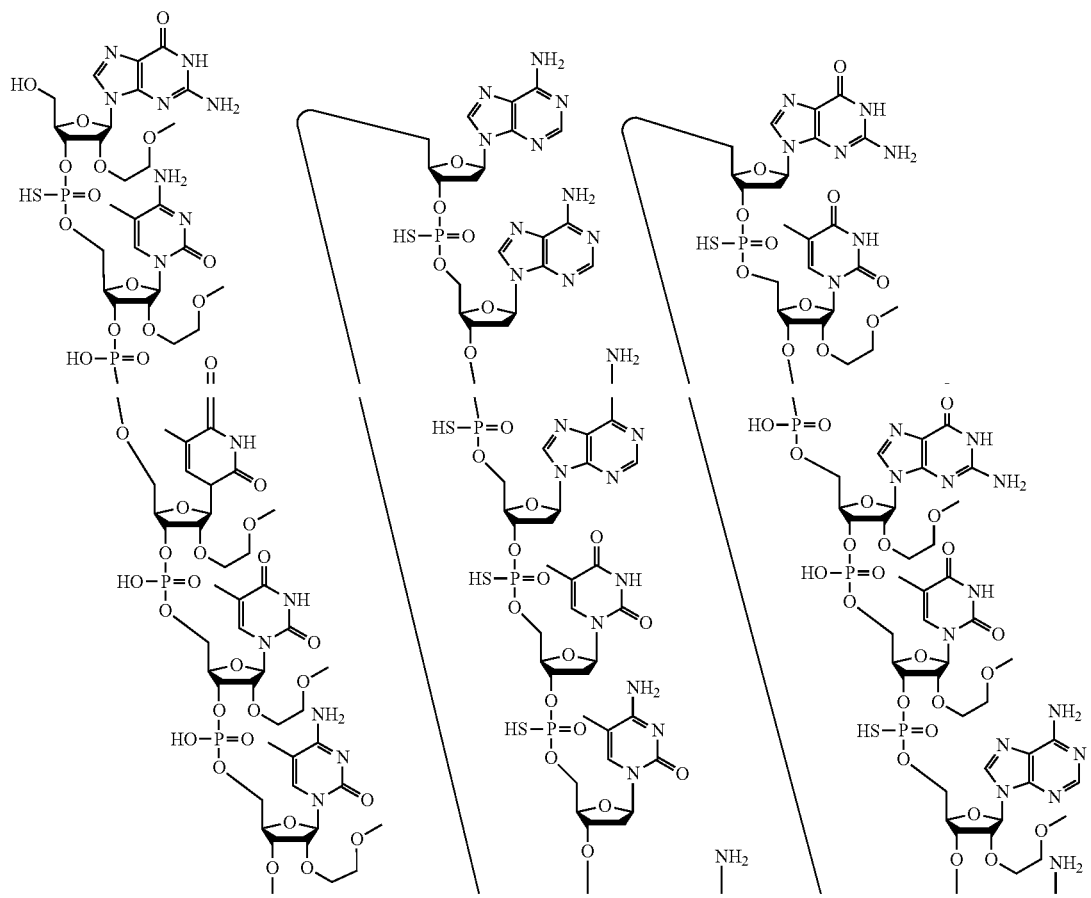

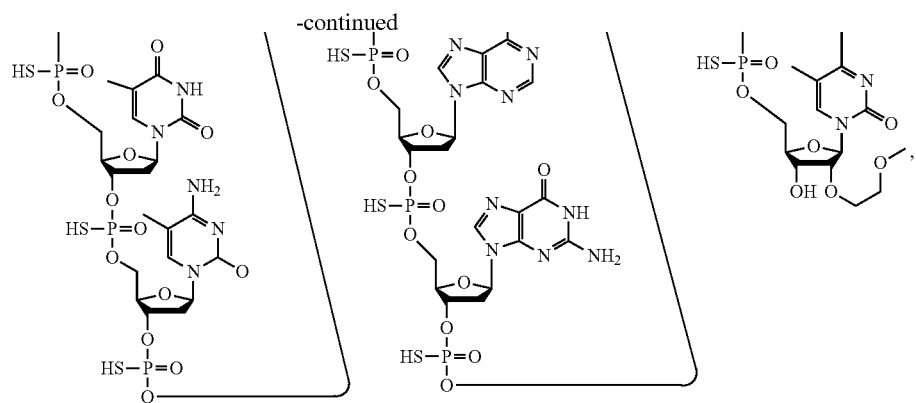
or a salt thereof.
Embodiment 59. A modified oligonucleotide according to the following chemical structure:
(SEQ ID NO: 3673)
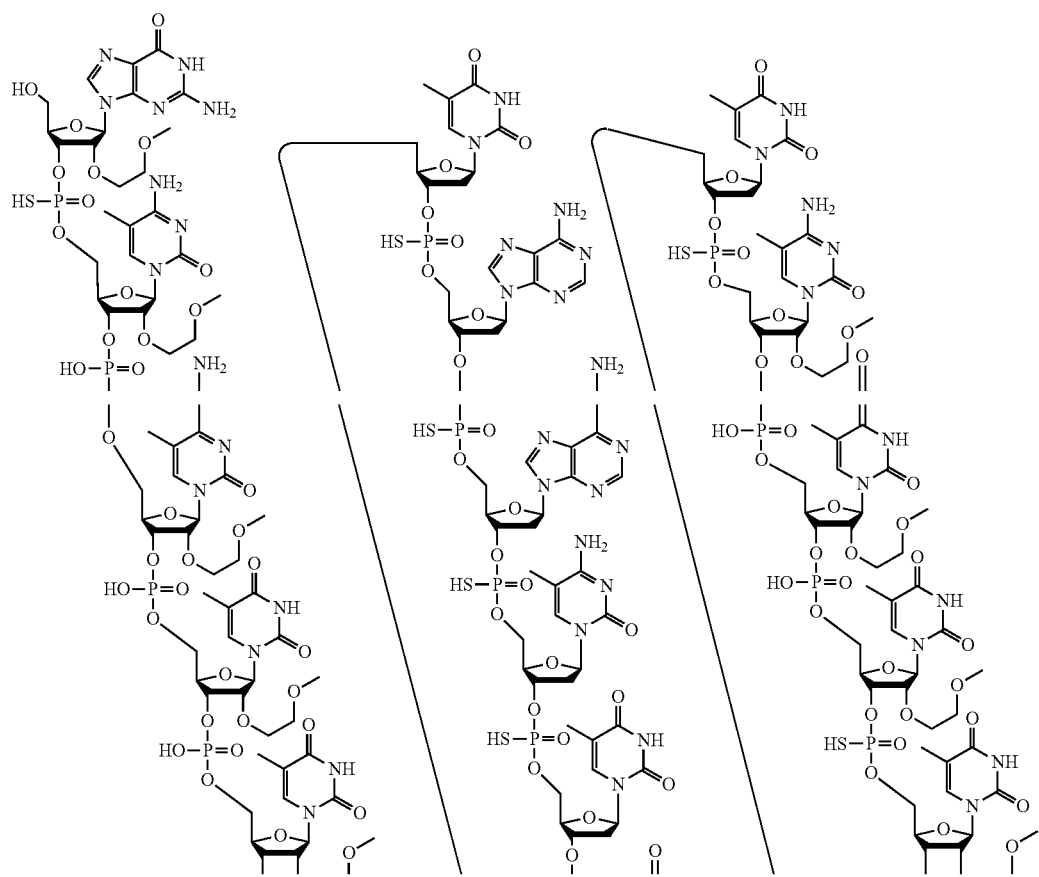

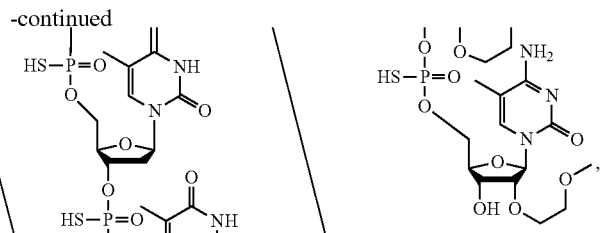
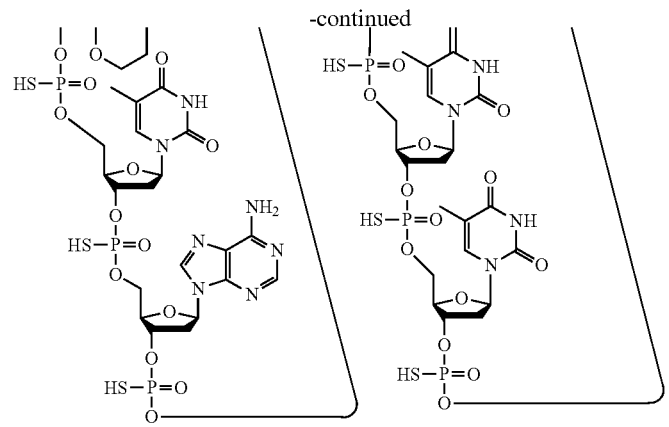
or a salt thereof.
Embodiment 60. A modified oligonucleotide according to the following chemical structure:
(SEQ ID NO: 3674)
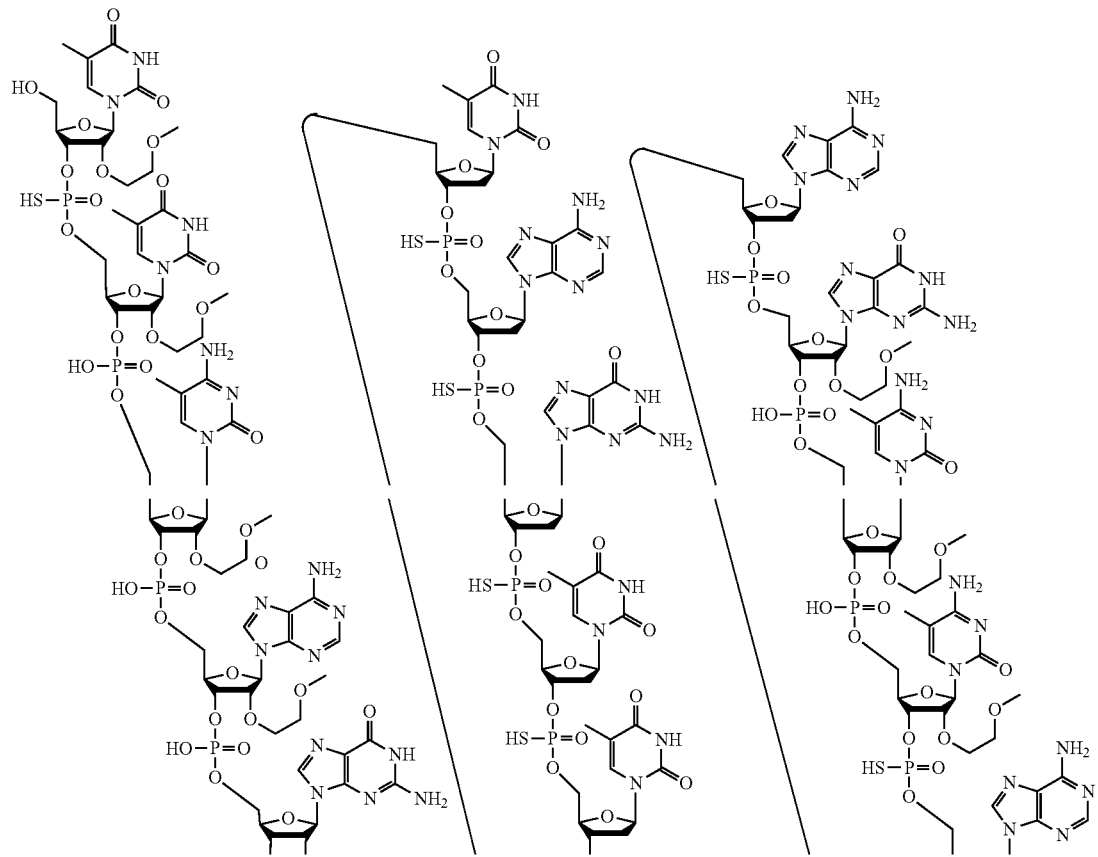

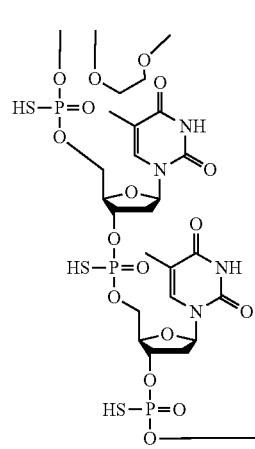
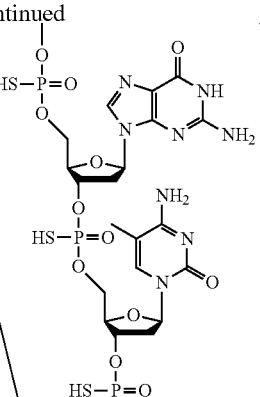
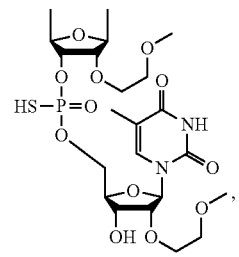
or a salt thereof.
Embodiment 61. A modified oligonucleotide according to the following chemical structure:
(SEQ ID NO: 3670)
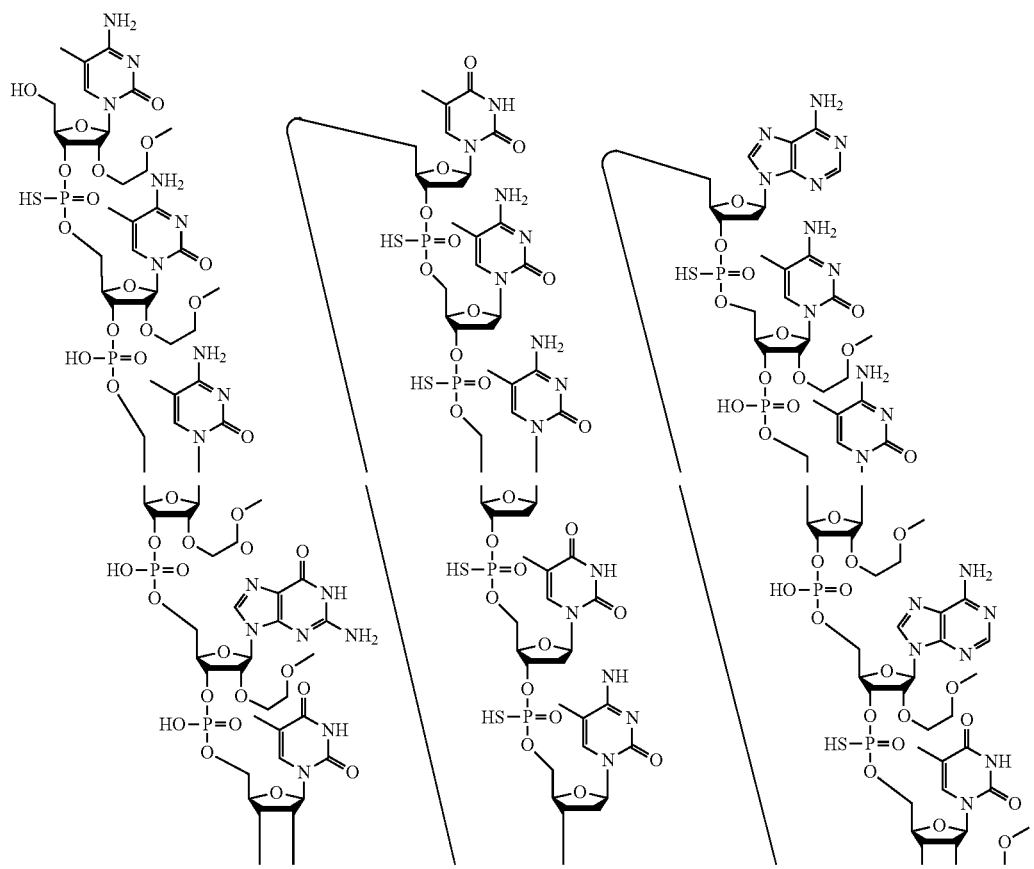

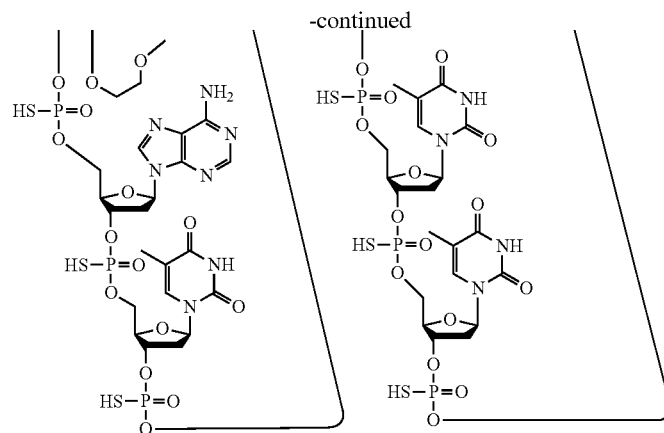
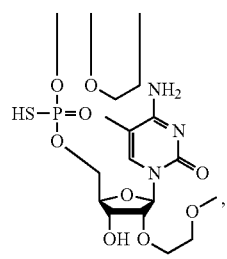
or a salt thereof.
Embodiment 62. A modified oligonucleotide according to the following chemical structure:
(SEQ ID NO: 3675)
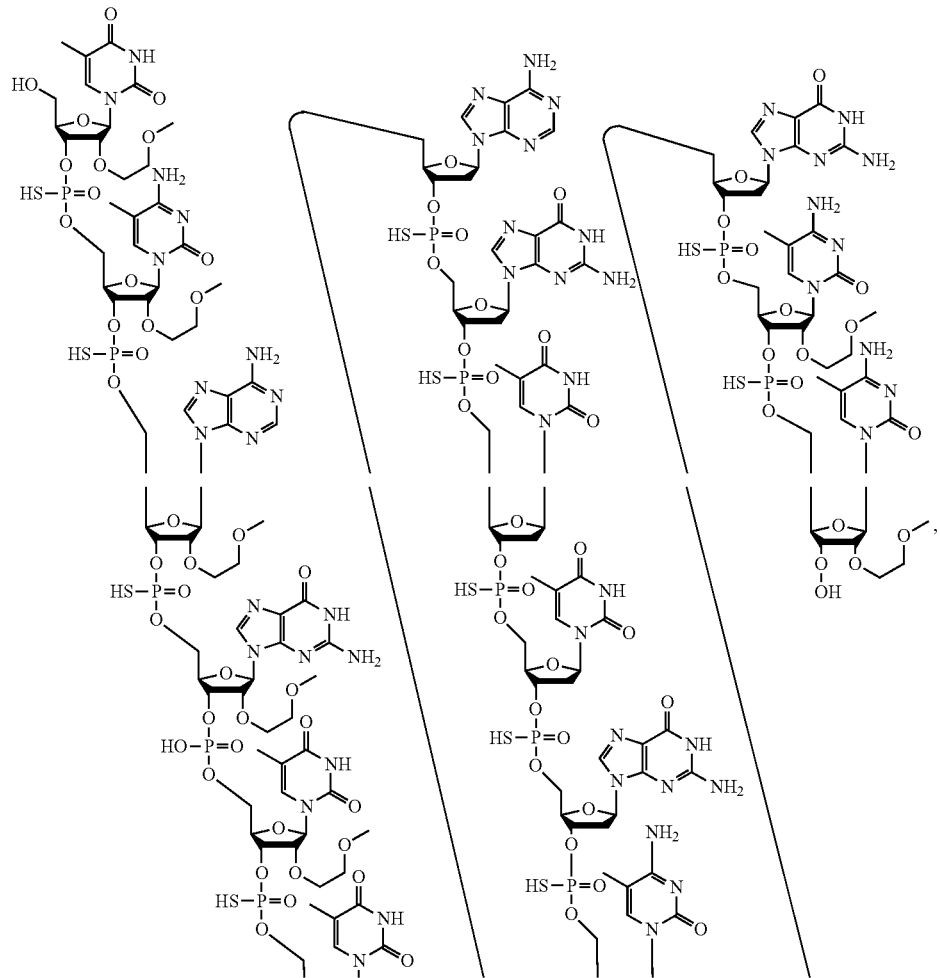

-continued
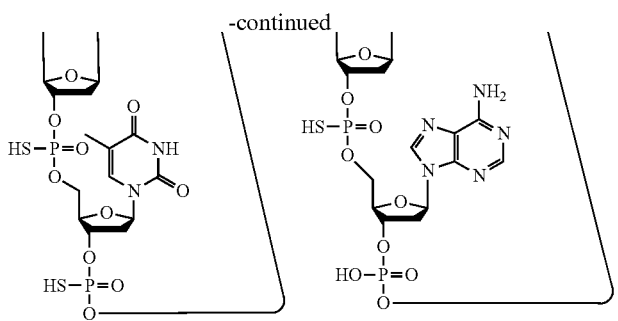
or a salt thereof.
Embodiment 63. A modified oligonucleotide according to the following chemical structure:
(SEQ ID NO: 3671)
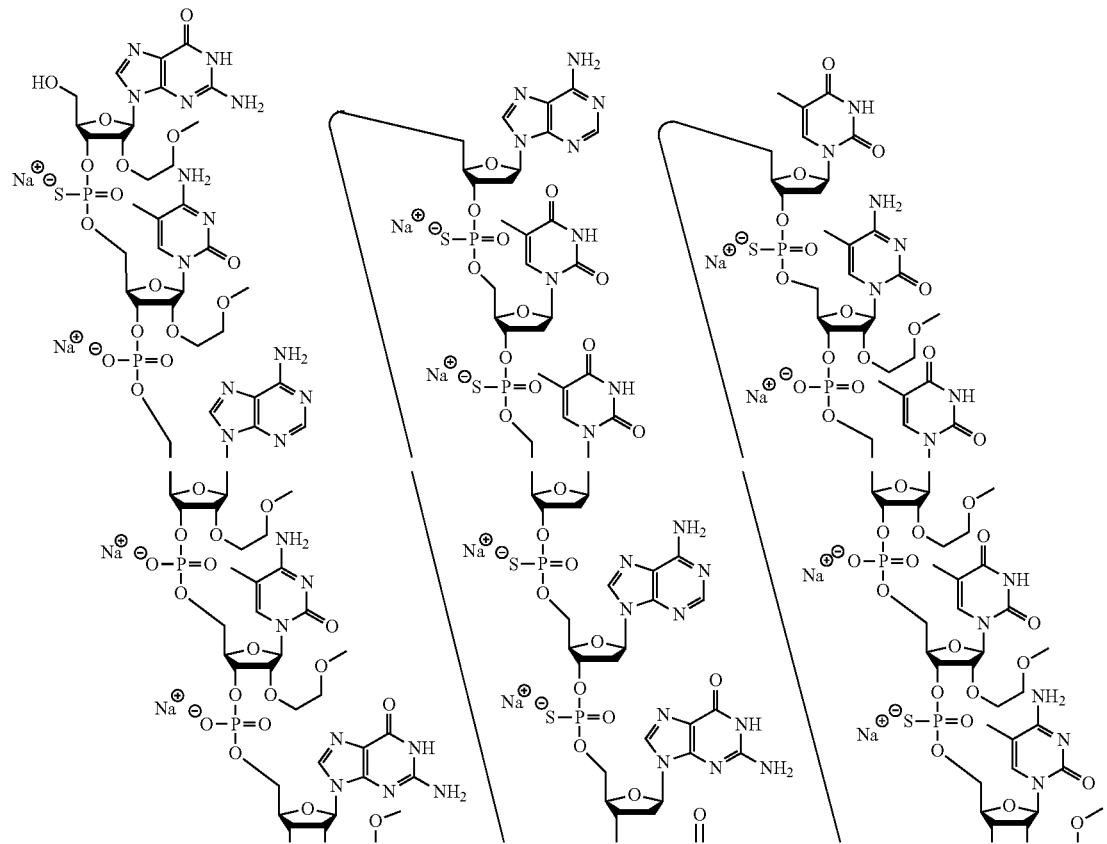

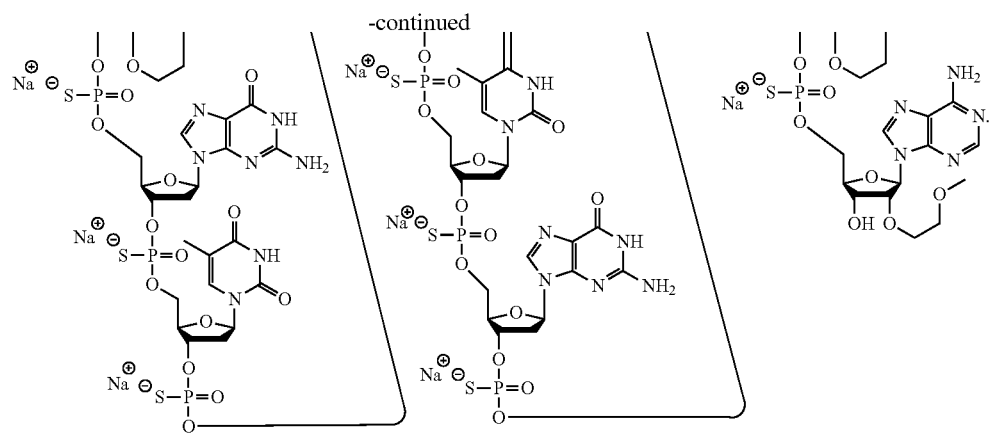
Embodiment 64. A modified oligonucleotide according to the following chemical structure:
(SEQ ID NO: 3672)
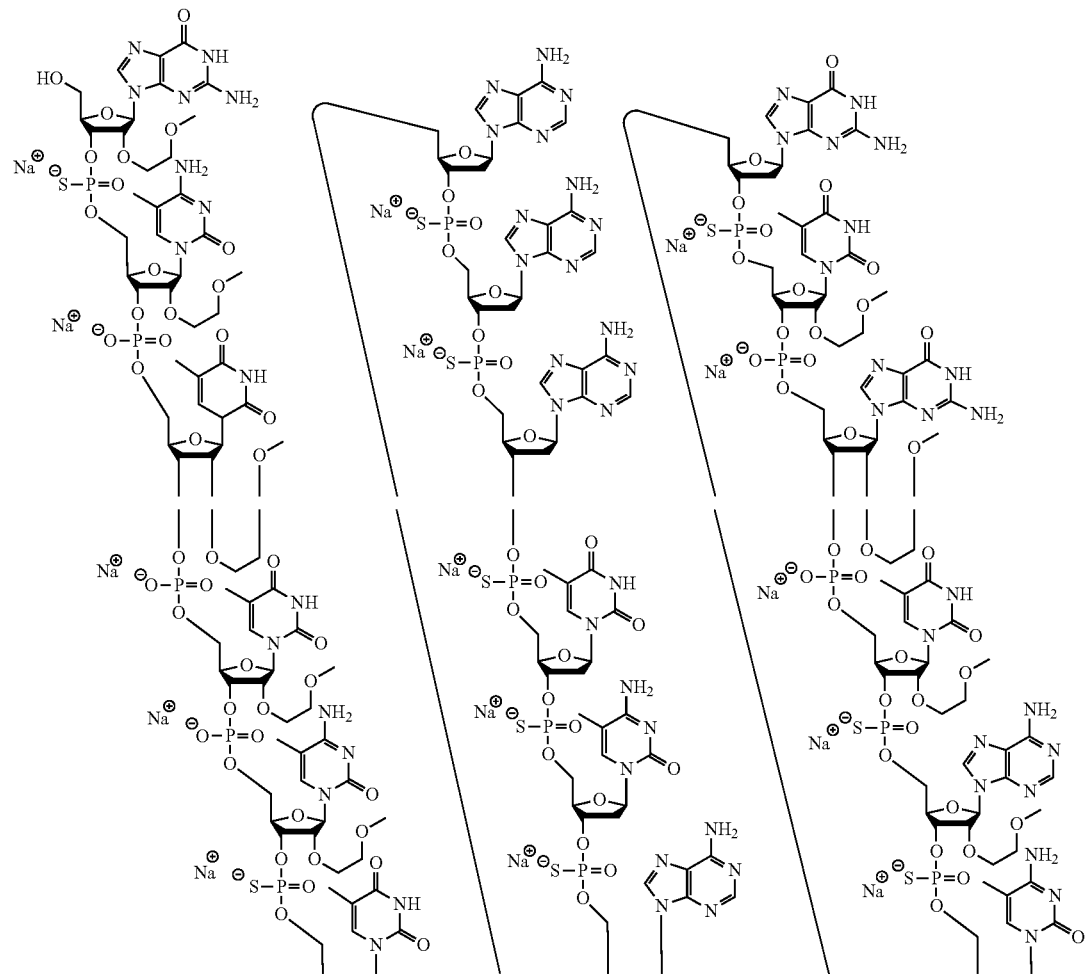

-continued
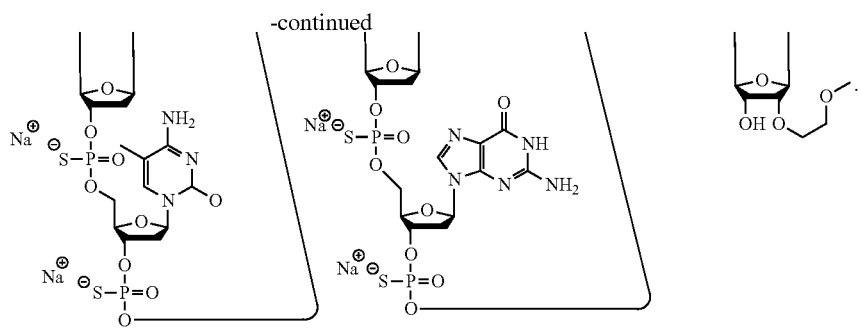
Embodiment 65. A modified oligonucleotide according to the following chemical structure:
(SEQ ID NO: 3673)
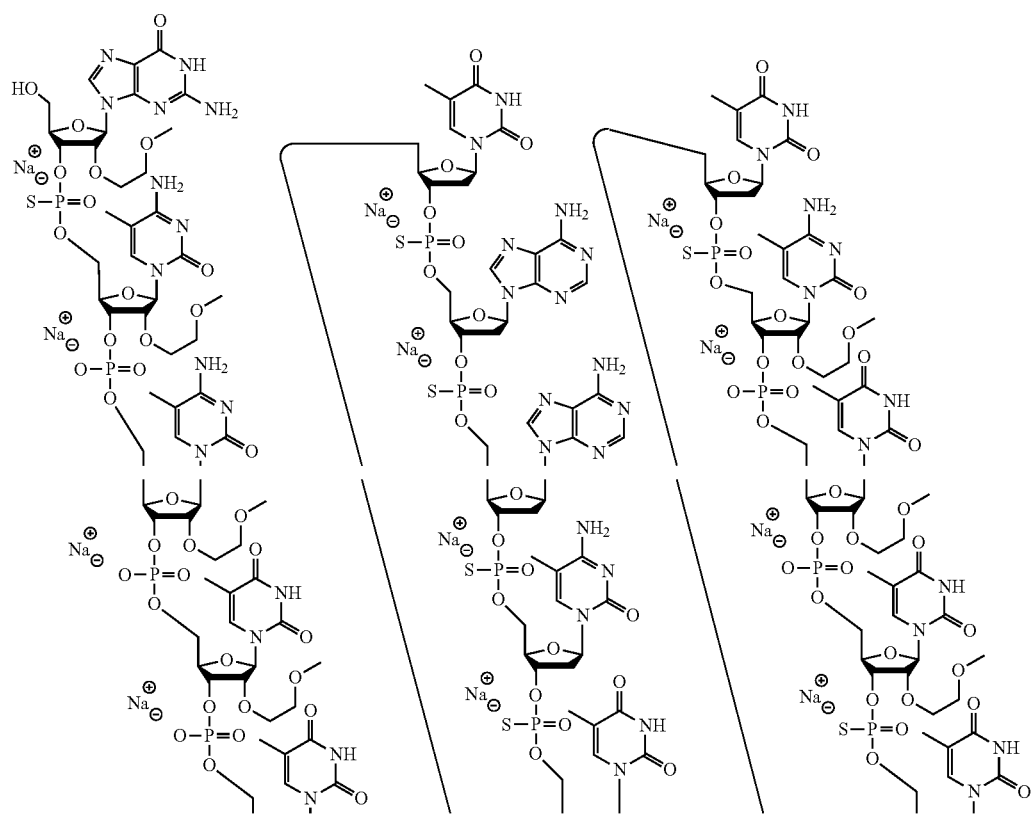

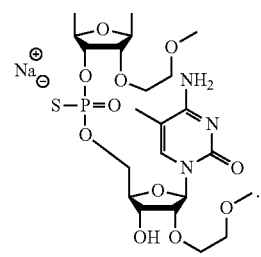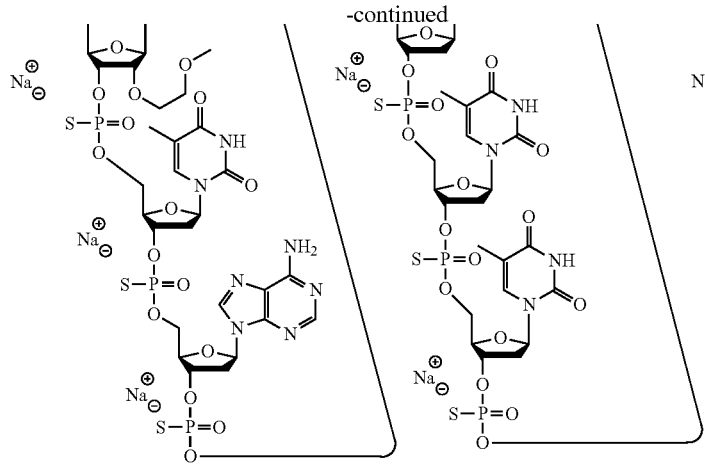
Embodiment 66. A modified oligonucleotide according to the following chemical structure:
(SEQ ID NO: 3674)
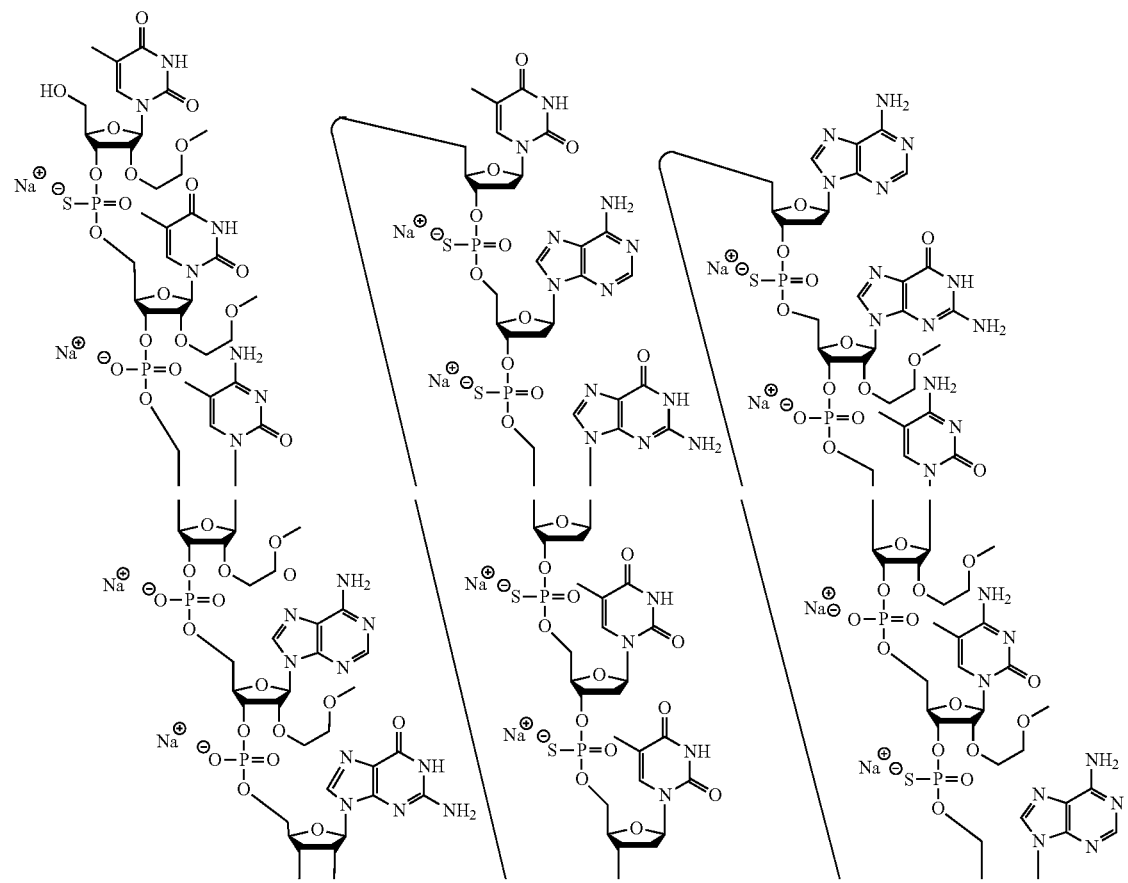

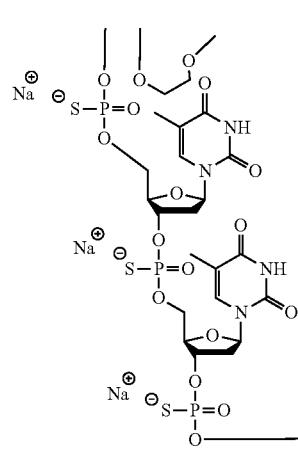
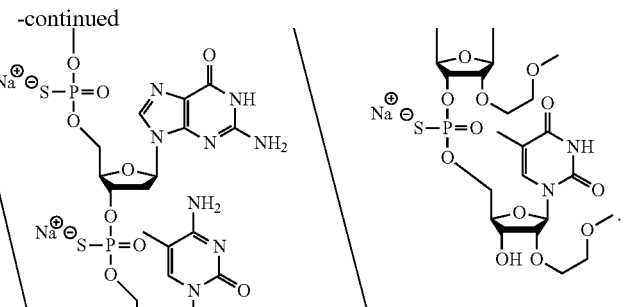
Embodiment 67. A modified oligonucleotide according to the following chemical structure:
(SEQ ID NO: 3670)
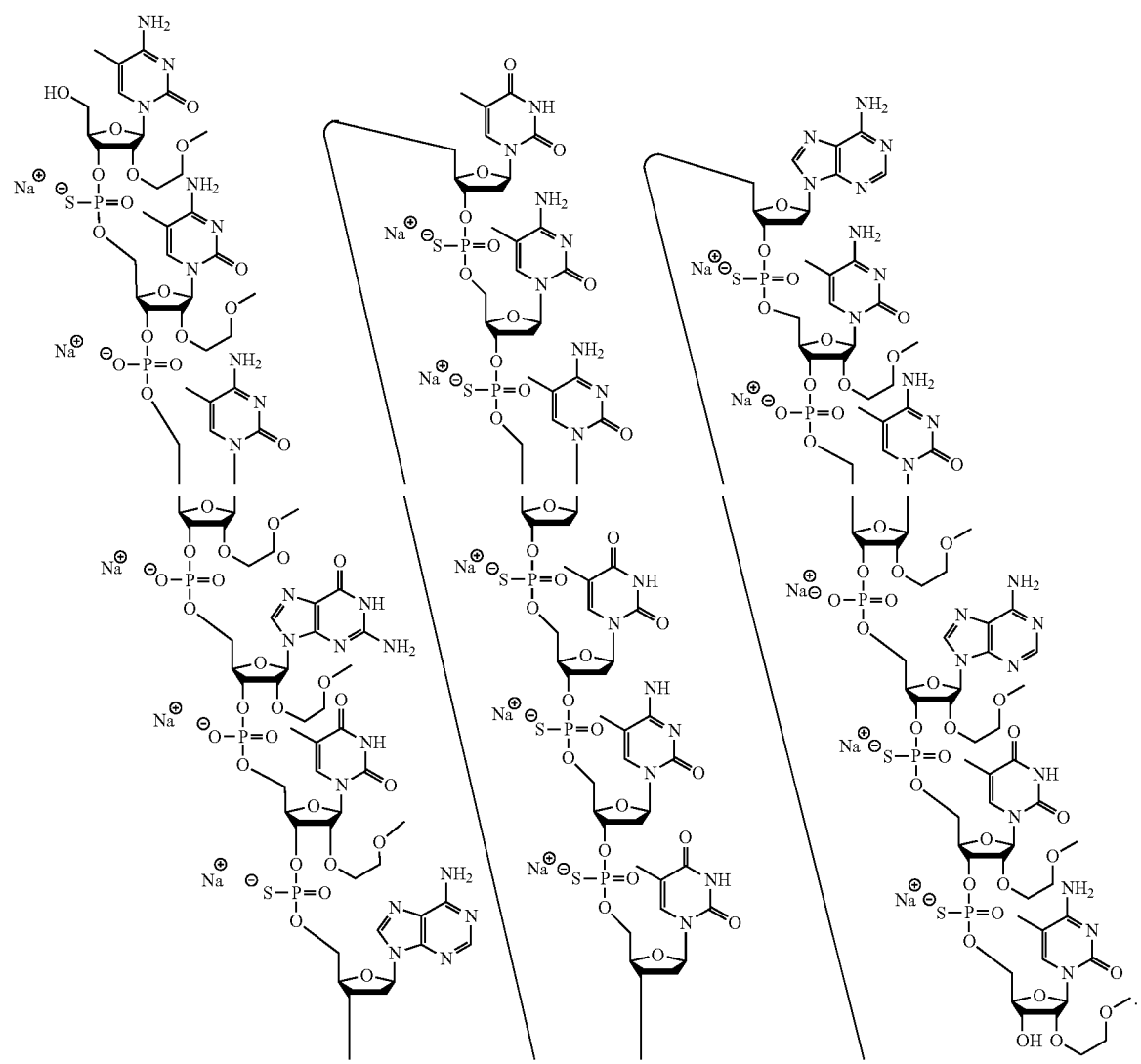

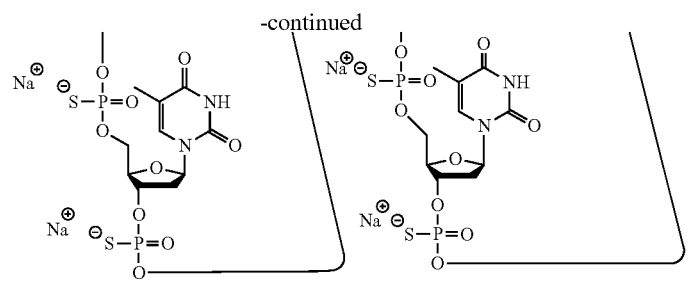
Embodiment 68. A modified oligonucleotide according to the following chemical structure:
(SEQ ID NO: 3675)
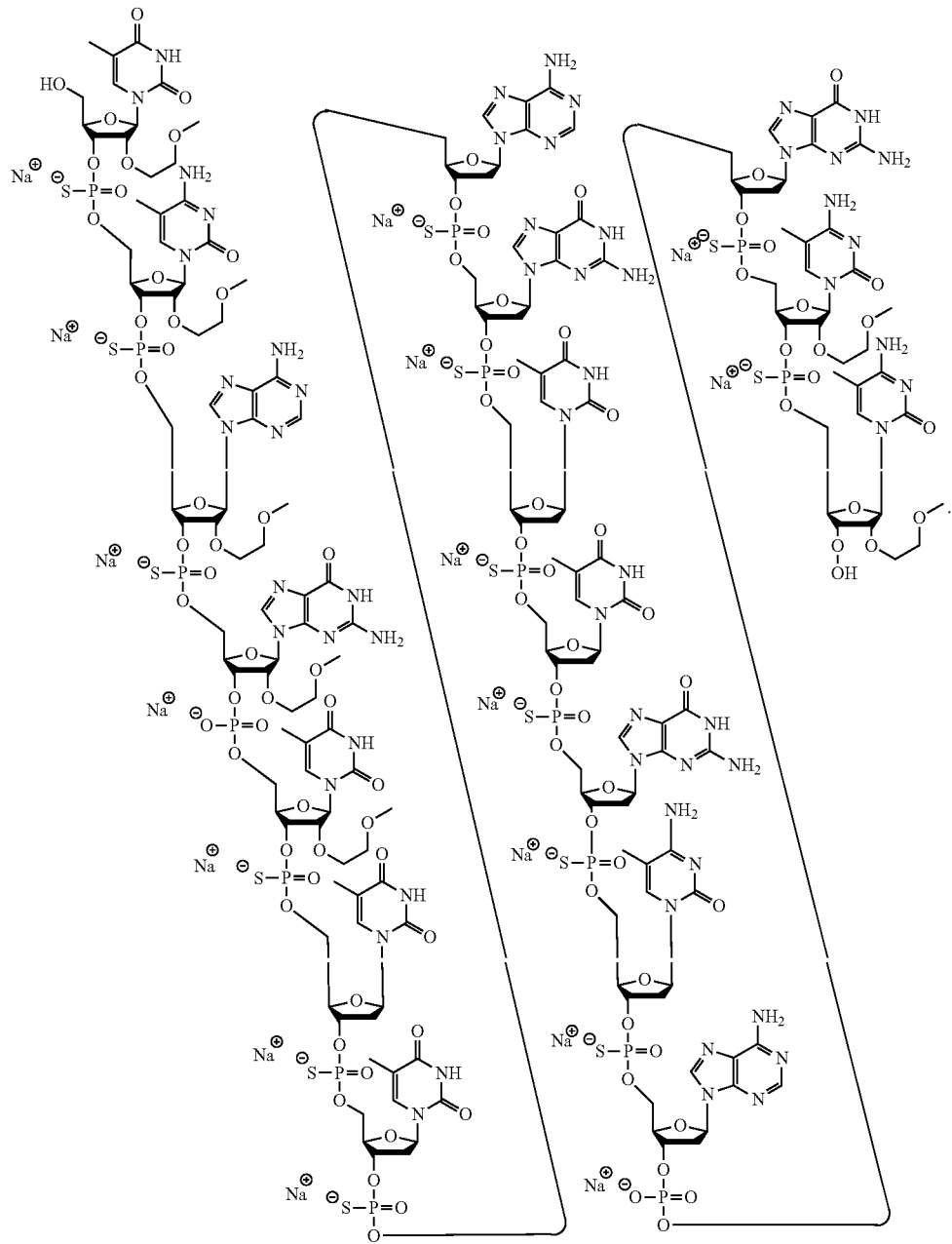

Embodiment 69. The modified oligonucleotide of embodiment 57-62, which is a sodium salt or a potassium salt.

Embodiment 70. A compound comprising a modified oligonucleotide according to the following chemical notation:

(SEQ ID NO: 3671)
Ges $^m$Ceo Aeo $^m$Ceo Ges Gds Tds Ads Tds Tds Ads Gds Tds Gds Tds $^m$Ceo Teo Tes $^m$Ces Ae, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 71. A compound comprising a modified oligonucleotide according to the following chemical notation:

(SEQ ID NO: 3672)
Ges $^m$Ceo Teo Teo $^m$Ces Tds $^m$Cds Ads Ads Ads Tds $^m$Cds Ads Gds Gds Teo Geo Tes Aes mCe, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 72. A compound comprising a modified oligonucleotide according to the following chemical notation:

(SEQ ID NO: 3673)
Ges $^m$Ceo $^m$Ceo Teo Tes Tds Ads Tds Ads Ads $^m$Cds Tds Tds Tds Tds $^m$Ceo Teo Tes Tes $^m$Ce, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 73. A compound comprising a modified oligonucleotide according to the following chemical notation:

(SEQ ID NO: 3674)
Tes Teo $^m$Ceo Aeo Ges Tds Tds Tds Ads Gds Tds Tds Gds $^m$Cds Ads Geo $^m$Ceo $^m$Ces Aes Te, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 74. A compound comprising a modified oligonucleotide according to the following chemical notation:

(SEQ ID NO: 3670)
$^m$Ces $^m$Ceo $^m$Ceo Geo Tes Ads Tds Tds Tds $^m$Cds $^m$Cds Tds $^m$Cds Tds Tds Ads $^m$Ceo $^m$Ceo Aes Tes $^m$Ce, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 75. A compound comprising a modified oligonucleotide according to the following chemical notation:

(SEQ ID NO: 3675)
Tes $^m$Ces Aes Geo Tes Tds Tds Ads Gds Tds Tds Gds $^m$Cds Aeo Ges $^m$Ces $^m$Ce, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 76. The compound of any of embodiments 73-78, comprising the modified oligonucleotide covalently linked to a conjugate group.

Embodiment 77. A chirally enriched population of modified oligonucleotides of any of embodiments 57-68, wherein the population is enriched for modified oligonucleotides comprising at least one particular phosphorothioate internucleoside linkage having a particular stereochemical configuration.

Embodiment 78. The chirally enriched population of embodiment 77, wherein the population is enriched for modified oligonucleotides comprising at least one particular phosphorothioate internucleoside linkage having the (Sp) or (Rp) configuration.

Embodiment 79. The chirally enriched population of embodiment 77, wherein the population is enriched for modified oligonucleotides having a particular, independently selected stereochemical configuration at each phosphorothioate internucleoside linkage.

Embodiment 80. The chirally enriched population of embodiment 77, wherein the population is enriched for modified oligonucleotides having the (Rp) configuration at one particular phosphorothioate internucleoside linkage and the (Sp) configuration at each of the remaining phosphorothioate internucleoside linkages.

Embodiment 81. The chirally enriched population of embodiment 77 wherein the population is enriched for modified oligonucleotides having at least 3 contiguous phosphorothioate internucleoside linkages in the Sp, Sp, and Rp configurations, in the 5' to 3' direction.

Embodiment 82. A population of modified oligonucleotides of any of embodiments 57-68, wherein all of the phosphorothioate internucleoside linkages of the modified oligonucleotide are stereorandom.

Embodiment 83. A pharmaceutical composition comprising the population of modified oligonucleotides of any of embodiments 77-82 and a pharmaceutically acceptable diluent or carrier.

Embodiment 84. A pharmaceutical composition of any of embodiments 62-75, and a pharmaceutically acceptable diluent or carrier.

Embodiment 85. The pharmaceutical composition of embodiment 84, wherein the pharmaceutically acceptable diluent is artificial cerebrospinal fluid or phosphate-buffered saline.

Embodiment 86. The pharmaceutical composition of embodiment 85, wherein the pharmaceutical composition consists essentially of the modified oligonucleotide and artificial cerebrospinal fluid or phosphate-buffered saline.

Embodiment 87. An oligomeric compound comprising a modified oligonucleotide consisting of 12 to 30 linked nucleosides wherein the nucleobase sequence of the modified oligonucleotide is at least 80% complementary to an equal length portion of an ATXN1 nucleic acid, and wherein the modified oligonucleotide comprises at least one modification selected from a modified sugar moiety and a modified internucleoside linkage.

Embodiment 88. The oligomeric compound of embodiment 87, wherein the ATXN1 nucleic acid has the nucleobase sequence of any of SEQ ID NO: 1, SEQ ID NO: 2, SEQ ID NO: 3, SEQ ID NO: 4, SEQ ID NO: 5, or SEQ ID NO: 6.

Embodiment 89. The oligomeric compound of embodiment 87 or embodiment 88, wherein the nucleobase sequence of the modified oligonucleotide is at least 80% complementary to an equal length portion within nucleobases:
an equal length portion of nucleobases 5472-5552 of SEQ ID NO: 1;
an equal length portion of nucleobases 5906-6005 of SEQ ID NO: 1;
an equal length portion of nucleobases 7868-7911 of SEQ ID NO: 1;
an equal length portion of nucleobases 8481-8514 of SEQ ID NO: 1; or
an equal length portion of nucleobases 446679-446706 of SEQ ID NO: 2.

Embodiment 90. The oligomeric compound of any of embodiments 87-89, wherein the nucleobase sequence of the modified oligonucleotide is at least 80% complementary to an equal length portion within nucleobases:
an equal length portion of nucleobases 5489-5508 of SEQ ID NO: 1;
an equal length portion of nucleobases 5491-5507 of SEQ ID NO: 1;
an equal length portion of nucleobases 5912-5931 of SEQ ID NO: 1;
an equal length portion of nucleobases 7892-7911 of SEQ ID NO: 1;
an equal length portion of nucleobases 8481-8500 of SEQ ID NO: 1; or
an equal length portion of nucleobases 446680-446699 of SEQ ID NO: 2.

Embodiment 91. The oligomeric compound of any of embodiments 87-90, wherein the nucleobase sequence of the modified oligonucleotide is at least 85%, at least 90%, at least 95%, or 100% complementary to an equal length portion of the ATXN1 nucleic acid.

Embodiment 92. An oligomeric compound comprising a modified oligonucleotide consisting of 12 to 30 linked nucleosides, wherein the modified oligonucleotide has a nucleobase sequence comprising at least 12, 13, 14, 16, 17, 18, 19, or 20 contiguous nucleobases of any of SEQ ID NOs: 22-3624 or 3655.

Embodiment 93. An oligomeric compound comprising a modified oligonucleotide consisting of 12 to 30 linked nucleosides, wherein the modified oligonucleotide has a nucleobase sequence comprising at least 12, 13, 14, 16, or 17 contiguous nucleobases of any of SEQ ID NOs: 3625-3654 or 3656-3669.

Embodiment 94. The oligomeric compound of embodiment 92 or 93, wherein the modified oligonucleotide has a nucleobase sequence comprising the nucleobase sequence of any of SEQ ID NO: 22-3669.

Embodiment 95. The oligomeric compound of embodiment 94, wherein the modified oligonucleotide has a nucleobase sequence consisting of the nucleobase sequence of any of SEQ ID NO: 22-3669.

Embodiment 96. The oligomeric compound of any of embodiments 92-95, wherein the modified oligonucleotide has a nucleobase sequence comprising at least 8, at least 9, at least 10, at least 11, at least 12, at least 13, at least 14, at least 15, at least 16, or at least 17 contiguous nucleobases of a sequence selected from:
SEQ ID NOs: 196, 274, 352, 430, 508, 2578, 2655, 2732, 2809, 2886, 2963, 3121, 3122, 3190, 3191, 3192, 3262, 3330, 3331, 3332, 3401, 3402, 3575, 3577, 3620, 3624, 3638-3640, 3653-3655, 3662, 3665, 3669;
SEQ ID Nos: 42, 120, 198, 276, 509, 587, 2502, 2579, 2656, 2733, 2810, 2887, 2964, 3585, 3588-3590, 3615, 3618, 3622, 3657, 3660, 3661, 3663, 3664, 3666-3668;
SEQ ID Nos: 48, 126, 2044, 2121;
SEQ ID Nos: 128, 206, 284, 1045, 1122, 1199, and 1276; or SEQ ID Nos: 2475, 2552, 2629, 2706, 2783, 3627-3630, 3644.

Embodiment 97. The oligomeric compound of any of embodiments 92-95, wherein the modified oligonucleotide has a nucleobase sequence comprising at least 8, at least 9, at least 10, at least 11, at least 12, at least 13, at least 14, at least 15, at least 16, or 17 contiguous nucleobases of any of the nucleobase sequences of SEQ ID NO: 3638.

Embodiment 98. The oligomeric compound of any of embodiments 92-95, wherein the modified oligonucleotide has a nucleobase sequence comprising at least 8, at least 9, at least 10, at least 11, at least 12, at least 13, at least 14, at least 15, at least 16, at least 17, at least 18, at least 19, or 20 contiguous nucleobases of any of the nucleobase sequences of SEQ ID NO: 126, 1045, 2552, 3190, or 3590.

Embodiment 99. The oligomeric compound of embodiment 97 or 98, wherein the modified oligonucleotide consists of 17 to 30 linked nucleosides and has a nucleobase sequence comprising the nucleobase sequence of any of 126, 1045, 2552, 3190, 3590, or 3638.

Embodiment 100. The oligomeric compound of embodiment 99, wherein the modified oligonucleotide has a nucleobase sequence consisting of the nucleobase sequence of any one of 126, 1045, 2552, 3190, 3590, or 3638.

Embodiment 101. The oligomeric compound of any of embodiments 92-100, wherein the nucleobase sequence of the modified oligonucleotide is at least 85%, at least 90%, at least 95%, or 100% complementary to an equal length portion of the ATXN1 nucleic acid, wherein the ATXN1 nucleic acid has the nucleobase sequence of SEQ ID NO: 1, SEQ ID NO: 2, SEQ ID NO: 3, SEQ ID NO: 4, SEQ ID NO: 5, or SEQ ID NO: 6.

Embodiment 102. The oligomeric compound of any of embodiments 87-101, wherein at least one nucleoside of the modified oligonucleotide comprises a modified sugar moiety.

Embodiment 103. The oligomeric compound of embodiment 102, wherein the modified sugar moiety comprises a bicyclic sugar moiety.

Embodiment 104. The oligomeric compound of embodiment 103, wherein the bicyclic sugar moiety comprises a 2'-4' bridge selected from —O—CH$_2$—; and —O—CH(CH$_3$)—.

Embodiment 105. The oligomeric compound of any of embodiments 102-104, wherein the modified nucleoside comprises a non-bicyclic modified sugar moiety.

Embodiment 106. The oligomeric compound of embodiment 105, wherein the non-bicyclic modified sugar moiety is a 2'-MOE sugar moiety or 2'-OMe modified sugar moiety.

Embodiment 107. The oligomeric compound of any of embodiments 102-106, wherein at least one nucleoside of the modified oligonucleotide comprises a sugar surrogate.

Embodiment 108. The oligomeric compound of embodiment 107, wherein the sugar surrogate is selected from morpholino and PNA.

Embodiment 109. The oligomeric compound of any of embodiments 87-102 or 105-108, wherein the modified oligonucleotide does not comprise a bicyclic sugar moiety.

Embodiment 110. The oligomeric compound of any of embodiments 87-109, wherein the modified oligonucleotide comprises at least one modified internucleoside linkage.

Embodiment 111. The oligomeric compound of embodiment 110, wherein at least one modified internucleoside linkage is a phosphorothioate internucleoside linkage.

Embodiment 112. The oligomeric compound of embodiment 110 or 111, wherein each internucleoside linkage is a modified internucleoside linkage.

Embodiment 113. The oligomeric compound of embodiment 112, wherein each internucleoside linkage is a phosphorothioate internucleoside linkage.

Embodiment 114. The oligomeric compound of any of embodiments 110-111, wherein at least one internucleoside linkage of the modified oligonucleotide is a phosphodiester internucleoside linkage.

Embodiment 115. The oligomeric compound of any of embodiments 87-109, wherein each internucleoside linkage of the modified oligonucleotide is independently selected from a phosphodiester or a phosphorothioate internucleoside linkage.

Embodiment 116. The oligomeric compound of any of embodiments 87-115, wherein at least 10, at least 11, at least 12, at least 13, at least 14, at least 15, at least 16, at least 17, or at least 18 internucleoside linkages of the modified oligonucleotide are phosphorothioate internucleoside linkages.

Embodiment 117. The oligomeric compound of embodiment 116, wherein the modified oligonucleotide has an internucleoside linkage motif selected from: sooosssssssssssoooss, sssosssssssssssosss, sssossssssssssoss, or sooooosssssssssssoss; wherein,
s=a phosphorothioate internucleoside linkage and o=a phosphodiester internucleoside linkage.

Embodiment 118. The oligomeric compound of any of embodiments 87-117, wherein the modified oligonucleotide comprises a modified nucleobase.

Embodiment 119. The oligomeric compound of embodiment 118, wherein the modified nucleobase is a 5-methyl cytosine.

Embodiment 120. The oligomeric compound of any of embodiments 1-33, wherein the modified oligonucleotide comprises a deoxy region consisting of 5-12 contiguous 2'-deoxynucleosides.

Embodiment 121. The oligomeric compound of embodiment 120, wherein each nucleoside of the deoxy region is a 2'-β-D-deoxynucleoside.

Embodiment 122. The oligomeric compound of embodiment 120 or 121 wherein the deoxy region consists of 6, 7, 8, 9, 10, or 6-10 linked nucleosides.

Embodiment 123. The oligomeric compound of any of embodiments 120-122, wherein each nucleoside immediately adjacent to the deoxy region comprises a modified sugar moiety.

Embodiment 124. The oligomeric compound of any of embodiments 120-122, wherein the deoxy region is flanked on the 5'-side by a 5'-region consisting of 1-6 linked 5'-region nucleosides and on the 3'-side by a 3' external region consisting of 1-6 linked 3'-region nucleosides; wherein
the 3'-most nucleoside of the 5'-region comprises a modified sugar moiety; and
the 5'-most nucleoside of the 3'-region comprises a modified sugar moiety.

Embodiment 125. The oligomeric compound of embodiment 124, wherein each nucleoside of the 3'-region comprises a modified sugar moiety.

Embodiment 126. The oligomeric compound of embodiment 124 or 125, wherein each nucleoside of the 5'-region comprises a modified sugar moiety.

Embodiment 127. The oligomeric compound of embodiment 120-126, wherein the modified oligonucleotide has
a 5'-region consisting of 1-6 linked nucleosides;
a deoxy region consisting of 6-10 linked nucleosides; and
a 3'-region consisting of 1-6 linked nucleosides; wherein
each of the 5'-region nucleosides and each of the 3'-region nucleosides comprises a modified sugar moiety.

Embodiment 128. The oligomeric compound of embodiment 127, wherein the modified oligonucleotide has
a 5'-region consisting of 6 linked nucleosides;
a deoxy region consisting of 10 linked nucleosides; and
a 3'-region consisting of 4 linked nucleosides; wherein
each of the 5'-region nucleosides and each of the 3'-region nucleosides is a 2'-MOE nucleoside, and
each of the deoxy region nucleosides is a 2'-β-D-deoxynucleoside.

Embodiment 129. The oligomeric compound of embodiment 127, wherein the modified oligonucleotide has
a 5'-region consisting of 5 linked nucleosides;
a central region consisting of 10 linked nucleosides; and a 3'-region consisting of 5 linked nucleosides; wherein each of the 5'-region nucleosides and each of the 3'-region nucleosides is a 2'-MOE nucleoside, and each of the deoxy region nucleosides is a 2'-β-D-deoxynucleoside.

Embodiment 130. The oligomeric compound of embodiment 127, wherein the modified oligonucleotide has
a 5'-region consisting of 5 linked nucleosides;
a deoxy region consisting of 8 linked nucleosides; and
a 3'-region consisting of 4 linked nucleosides; wherein each of the 5'-region nucleosides and each of the 3'-region nucleosides is a 2'-MOE nucleoside, and each of the deoxy region nucleosides is a 2'-β-D-deoxynucleoside.

Embodiment 131. The oligomeric compound of embodiment 127, wherein the modified oligonucleotide has
a 5'-region consisting of 5 linked nucleosides;
a deoxy region consisting of 8 linked nucleosides; and
a 3'-region consisting of 4 linked nucleosides; wherein each of the 5'-region nucleosides is a 2'-MOE nucleoside, each of the 3'-region nucleosides is selected from a 2'-MOE nucleoside and a cEt nucleoside, and each of the deoxy region nucleosides is a 2'-β-D-deoxynucleoside.

Embodiment 132. The oligomeric compound of any of embodiments 87-119, wherein the modified oligonucleotide has
a 5' region consisting of 3-7 linked nucleosides;
a deoxy region consisting of 6-8 linked nucleosides; and
a 3' region consisting of 3-6 linked nucleosides; wherein
each of the 3' region nucleosides is selected from a 2'-MOE nucleoside and a cEt nucleoside, and the region has the following formula:

(N$k$)$n$(N$d$)(N$x$)

wherein each Nk is a bicyclic nucleoside, Nx is a 2'-OMe nucleoside and Nd is a 2'-β-D-deoxynucleoside;
and n is from 1-5.

Embodiment 133. The oligomeric compound of any of embodiments 87-119, wherein the modified oligonucleotide has
a 5' region consisting of 7 linked nucleosides;
a deoxy region consisting of 6 linked nucleosides; and
a 3' region consisting of 4 linked nucleosides; wherein each of the 3' region nucleosides is selected from a 2'-MOE nucleoside and a cEt nucleoside, and the region has the following formula:

(N$k$)$n$(N$d$)(N$x$)

wherein each Nk is a bicyclic nucleoside, Nx is a 2'-OMe nucleoside and Nd is a 2'-β-D-deoxynucleoside;
and n is from 5.

Embodiment 134. The oligomeric compound of any of embodiments 87-133, wherein the modified oligonucleotide consists of 12-30, 12-22, 12-20, 14-18, 16-18, 14-20, 15-17, 15-25, 16-20, or 17-20 linked nucleosides.

Embodiment 135. The oligomeric compound of any of embodiments 87-132, wherein the modified oligonucleotide consists of 18-22 or 18-20 linked nucleosides.

Embodiment 136. The oligomeric compound of any of embodiments 87-133, wherein the modified oligonucleotide consists of 17 linked nucleosides.

Embodiment 137. The oligomeric compound of any of embodiments 87-132, wherein the modified oligonucleotide consists of 20 linked nucleosides.

Embodiment 138. A compound comprising a modified oligonucleotide according to the following chemical notation:

(SEQ ID NO: 3671)
Ges $^m$Ceo Aeo $^m$Ceo Ges Gds Tds Ads Tds Tds Ads Gds

Tds Gds Tds $^m$Ceo Teo Tes $^m$Ces Ae, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 139. A compound comprising a modified oligonucleotide according to the following chemical notation:

(SEQ ID NO: 3672)
Ges $^m$Ceo Teo Teo $^m$Ces Tds $^m$Cds Ads Ads Ads Tds $^m$Cds Ads Gds Gds Teo Geo Tes Aes $^m$Ce, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 140. A compound comprising a modified oligonucleotide according to the following chemical notation:

(SEQ ID NO: 3673)
Ges $^m$Ceo $^m$Ceo Teo Tes Tds Ads Tds Ads Ads $^m$Cds

Tds Tds Tds Tds $^m$Ceo Teo Tes Tes $^m$Ce, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 141. A compound comprising a modified oligonucleotide according to the following chemical notation:

(SEQ ID NO: 3674)
Tes Teo $^m$Ceo Aeo Ges Tds Tds Tds Ads Gds Tds Tds

Gds $^m$Cds Ads Geo $^m$Ceo $^m$Ces Aes Te, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 142. A compound comprising a modified oligonucleotide according to the following chemical notation:

(SEQ ID NO: 3670)
$^m$Ces $^m$Ceo $^m$Ceo Geo Tes Ads Tds Tds $^m$Cds $^m$Cds Tds $^m$Cds Tds Tds Ads $^m$Ceo $^m$Ceo Aes Tes $^m$Ce, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 143. A compound comprising a modified oligonucleotide according to the following chemical notation:

(SEQ ID NO: 3675)
Tes $^m$Ces Aes Geo Tes Tds Tds Ads Gds Tds Tds Gds $^m$Cds Aeo Ges $^m$Ces $^m$Ce, wherein,
A=an adenine nucleobase,
$^m$=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

Embodiment 144. The oligomeric compound of any of embodiments 87-143, consisting of the modified oligonucleotide.

Embodiment 145. The oligomeric compound of any of embodiments 87-144, comprising a conjugate group comprising a conjugate moiety and a conjugate linker.

Embodiment 146. The oligomeric compound of embodiment 145, wherein the conjugate linker consists of a single bond.

Embodiment 147. The oligomeric compound of embodiment 145, wherein the conjugate linker is cleavable.

Embodiment 148. The oligomeric compound of embodiment 145, wherein the conjugate linker comprises 1-3 linker nucleosides.

Embodiment 149. The oligomeric compound of any of embodiments 145-148, wherein the conjugate linker does not comprise any linker nucleosides.

Embodiment 150. The oligomeric compound of any of embodiments 145-148, wherein the conjugate group is attached to the modified oligonucleotide at the 5'-end of the modified oligonucleotide.

Embodiment 151. The oligomeric compound of any of embodiments 145-148, wherein the conjugate group is attached to the modified oligonucleotide at the 3'-end of the modified oligonucleotide.

Embodiment 152. The oligomeric compound of any of embodiments 87-143 or 146-148, comprising a terminal group.

Embodiment 153. The oligomeric compound of embodiment 152, wherein the terminal group is an abasic sugar moiety.

Embodiment 154. The oligomeric compound of any of embodiments 87-153 wherein the oligomeric compound is a singled-stranded oligomeric compound.

Embodiment 155. A modified oligonucleotide according to the following chemical structure:

(SEQ ID NO: 3671)

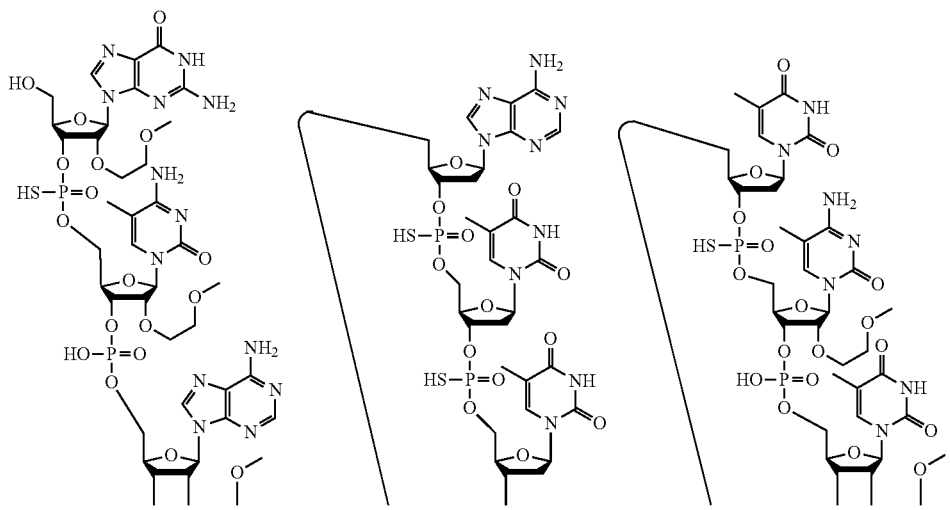

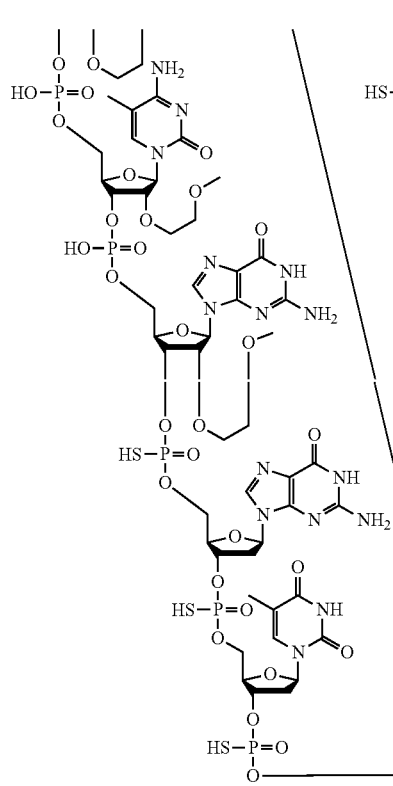
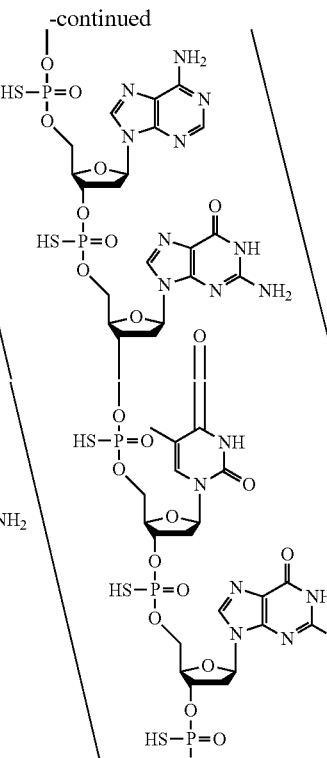
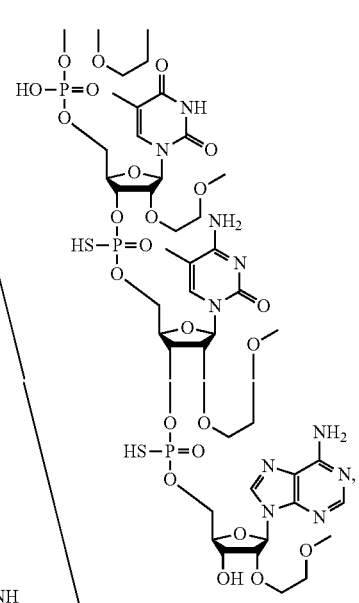
or a salt thereof.
Embodiment 156. A modified oligonucleotide according to the following chemical structure:
(SEQ ID NO: 3672)
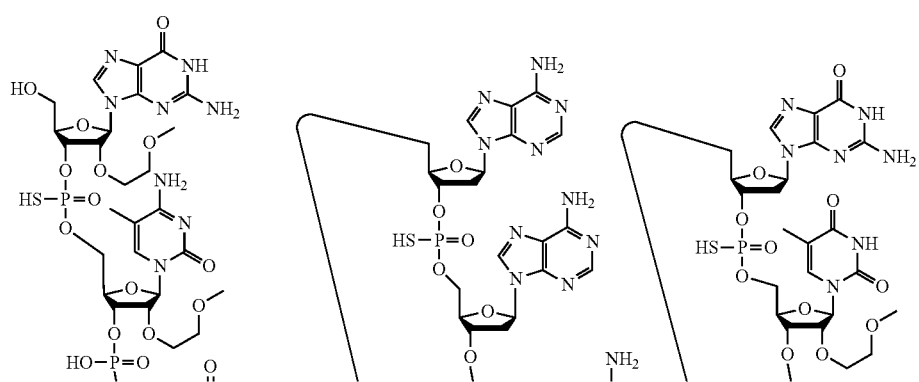

49
50
-continued
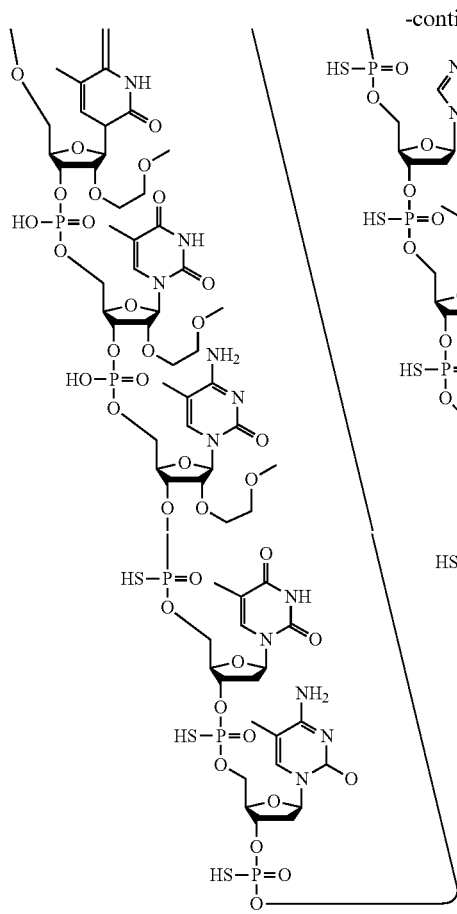
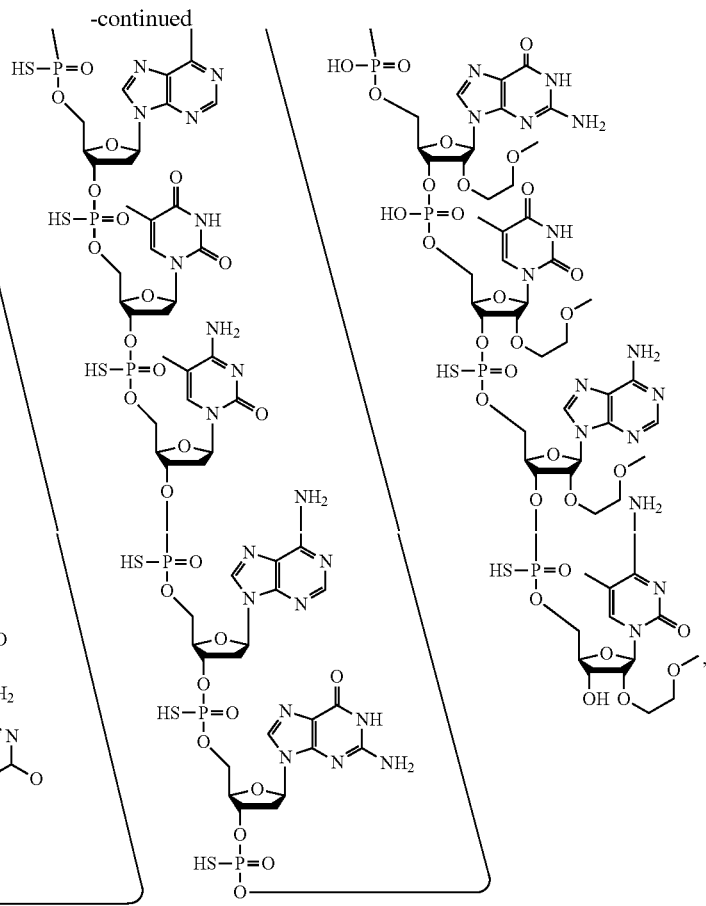
or a salt thereof.
Embodiment 157. A modified oligonucleotide according to the following chemical structure:
(SEQ ID NO: 3673)
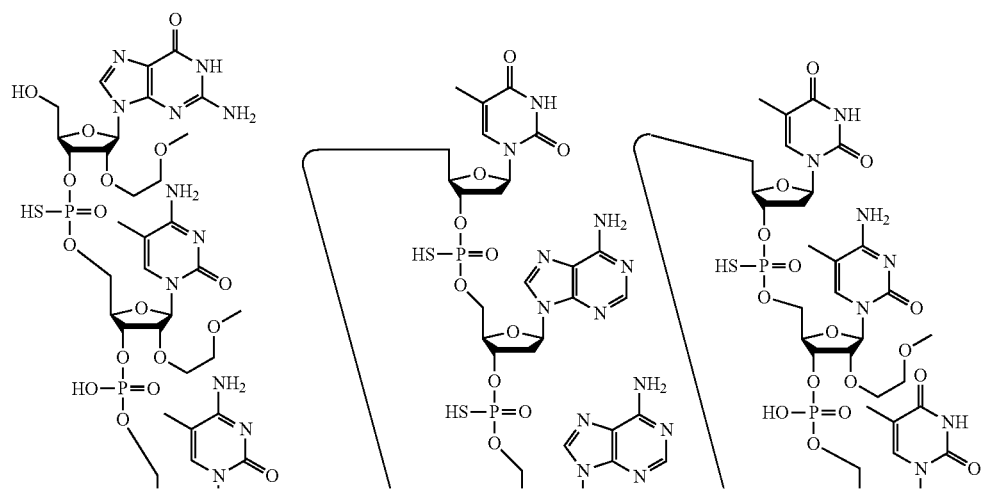

51
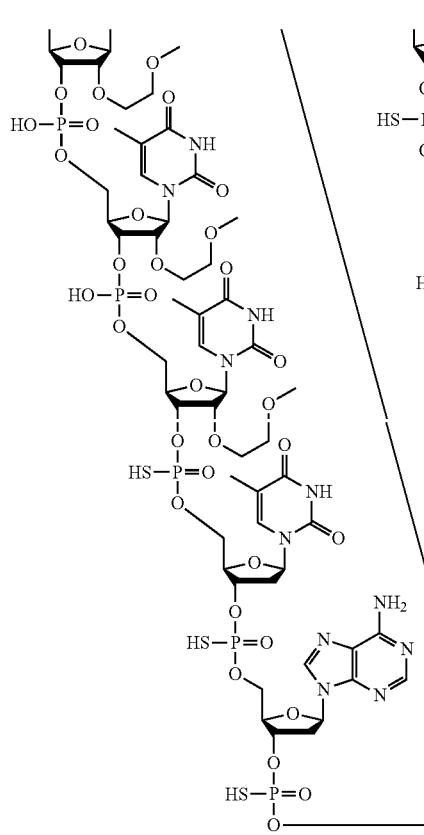
-continued
52
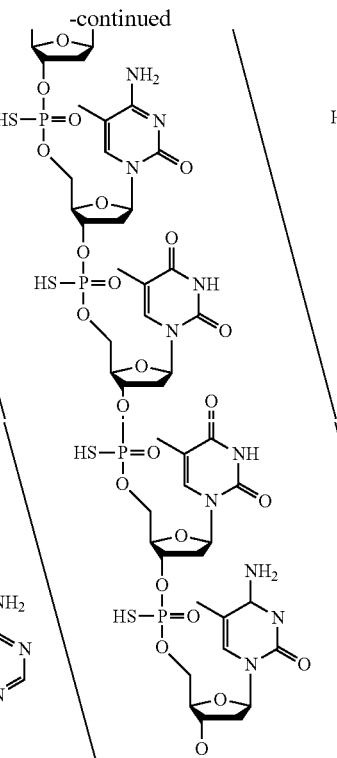
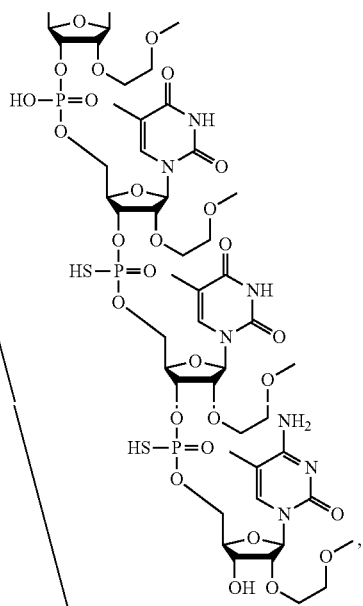
or a salt thereof.
Embodiment 158. A modified oligonucleotide according to the following chemical structure:
(SEQ ID NO: 3674)
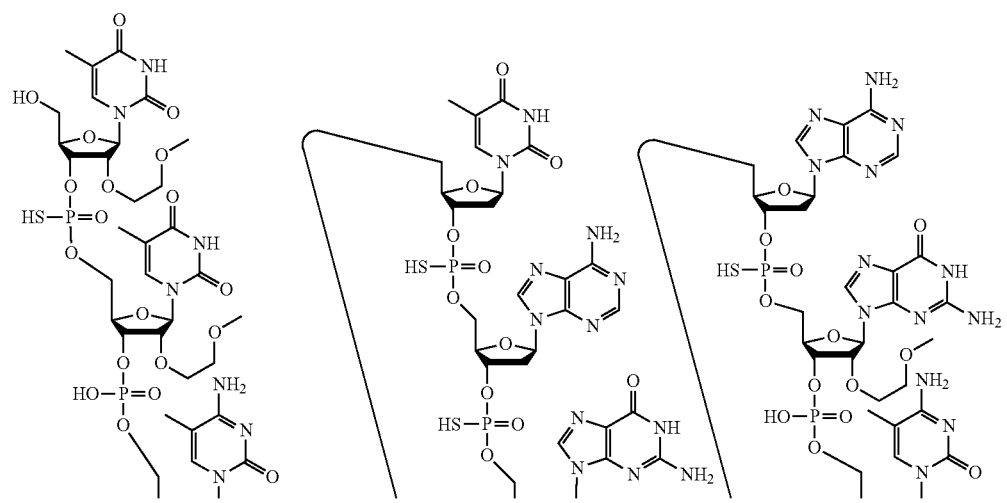

-continued
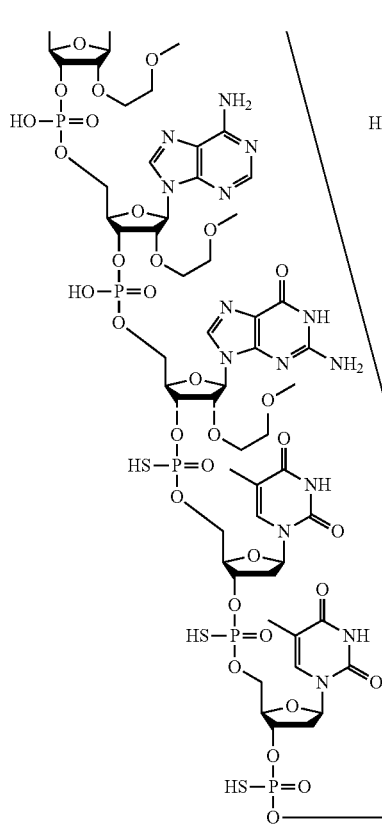
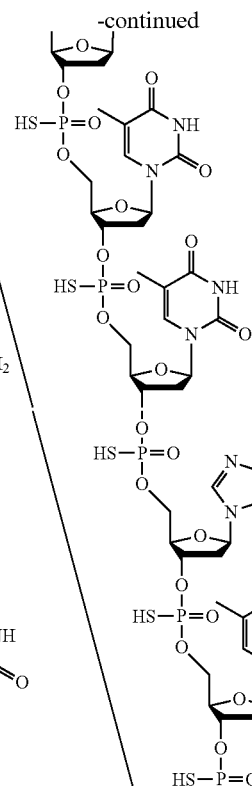
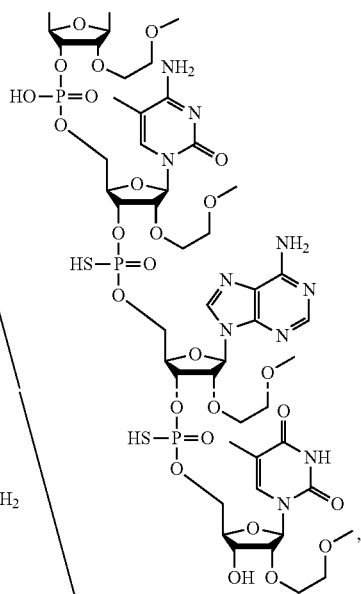
or a salt thereof.
Embodiment 159. A modified oligonucleotide according to the following chemical structure:
(SEQ ID NO: 3670)
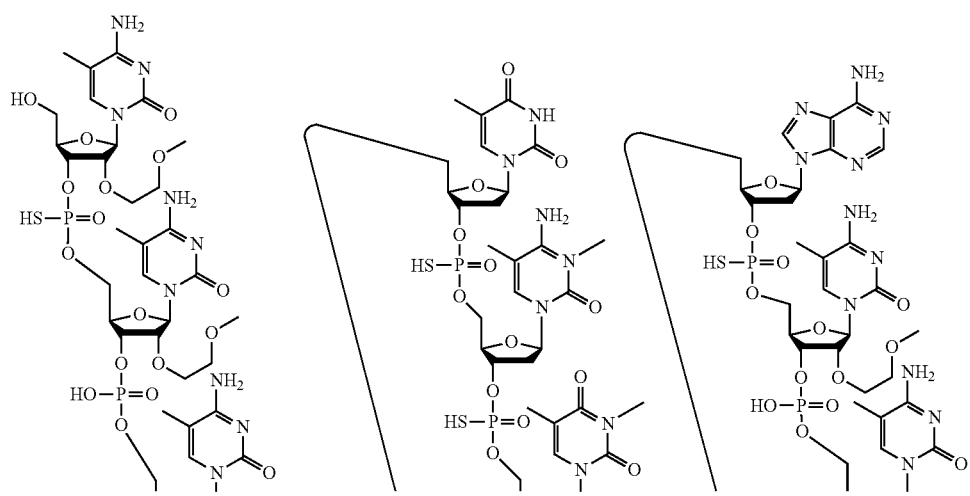

-continued
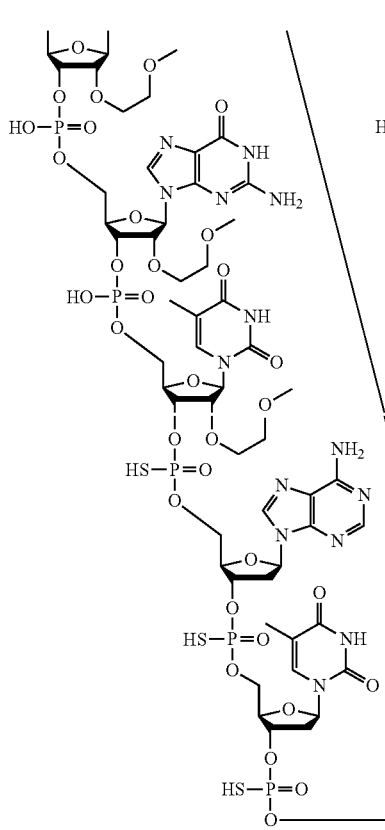
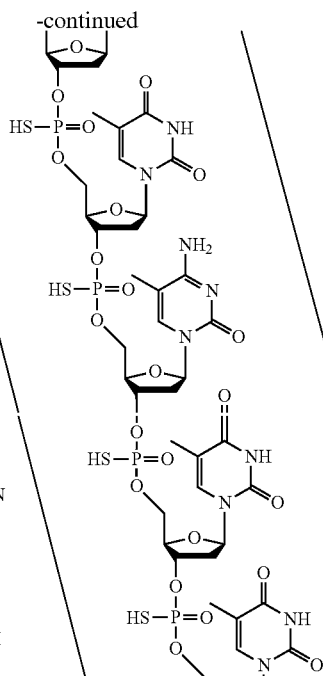
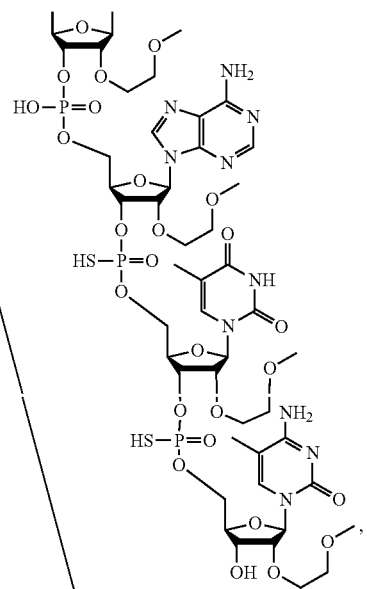
or a salt thereof.
Embodiment 160. A modified oligonucleotide according to the following chemical structure:
(SEQ ID NO: 3675)
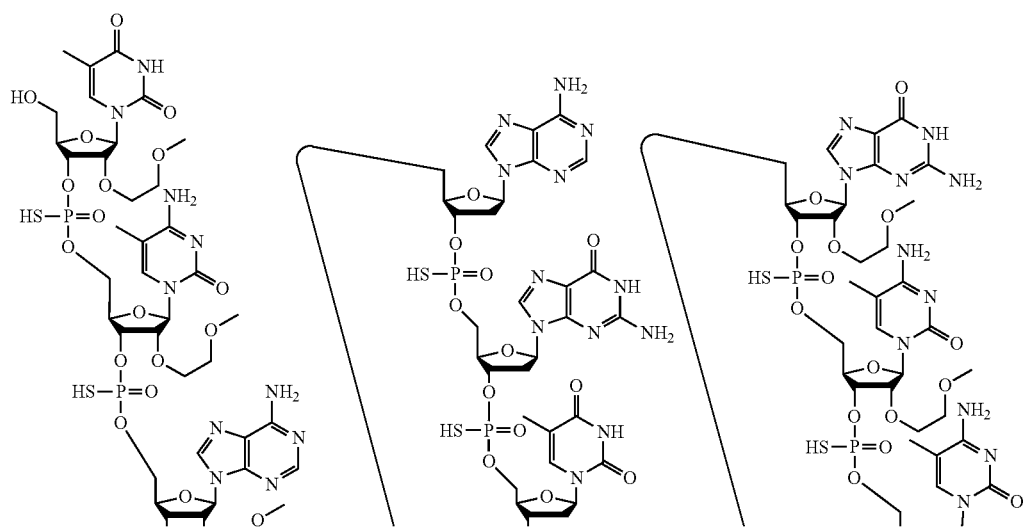

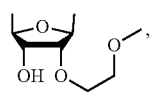
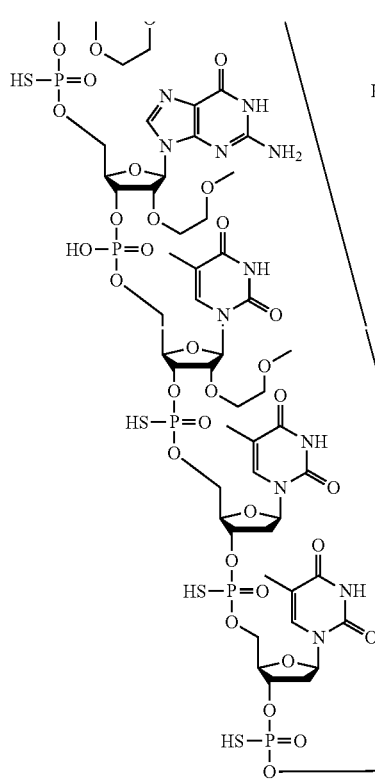
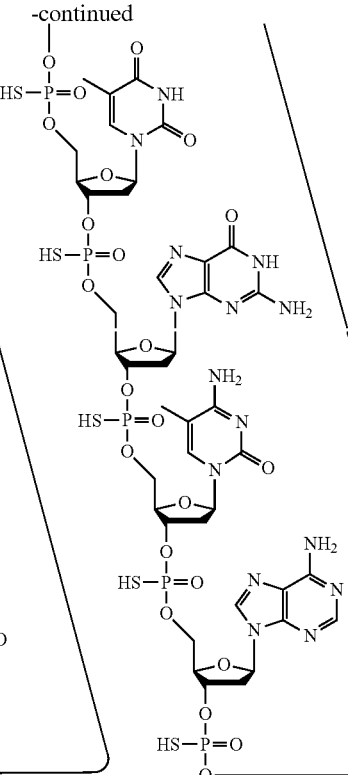
or a salt thereof.
Embodiment 161. The modified oligonucleotide of any of embodiments 155-160, which is the sodium salt or the potassium salt.
Embodiment 162. A modified oligonucleotide according to the following chemical structure:
(SEQ ID NO: 3671)
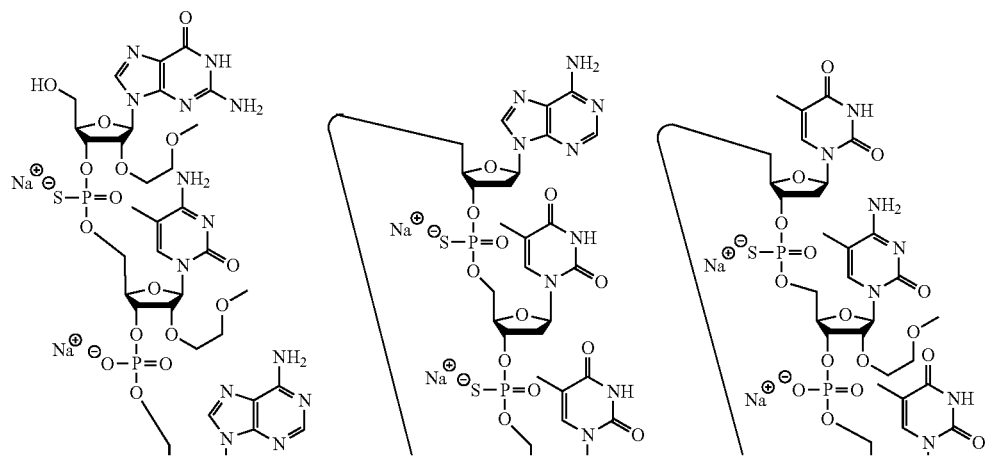

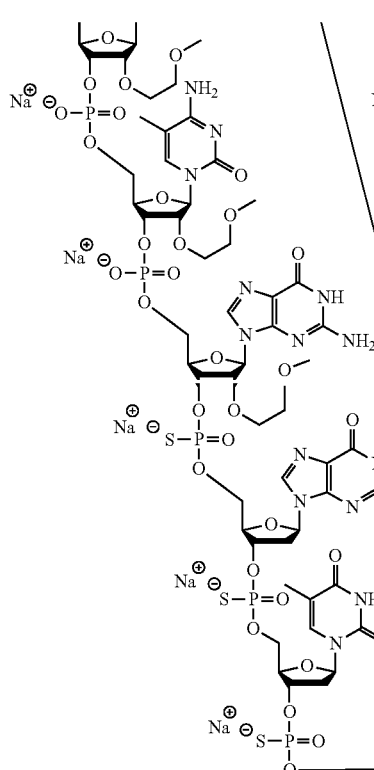
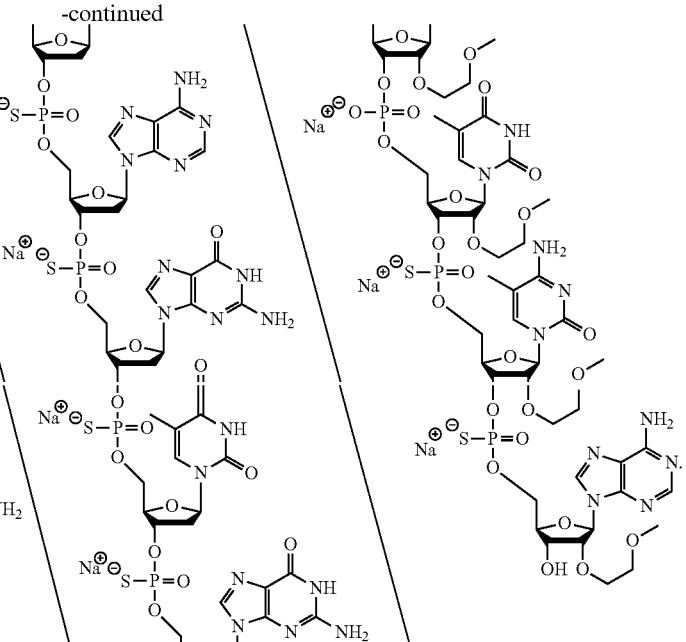
Embodiment 163. A modified oligonucleotide according to the following chemical structure:
(SEQ ID NO: 3672)
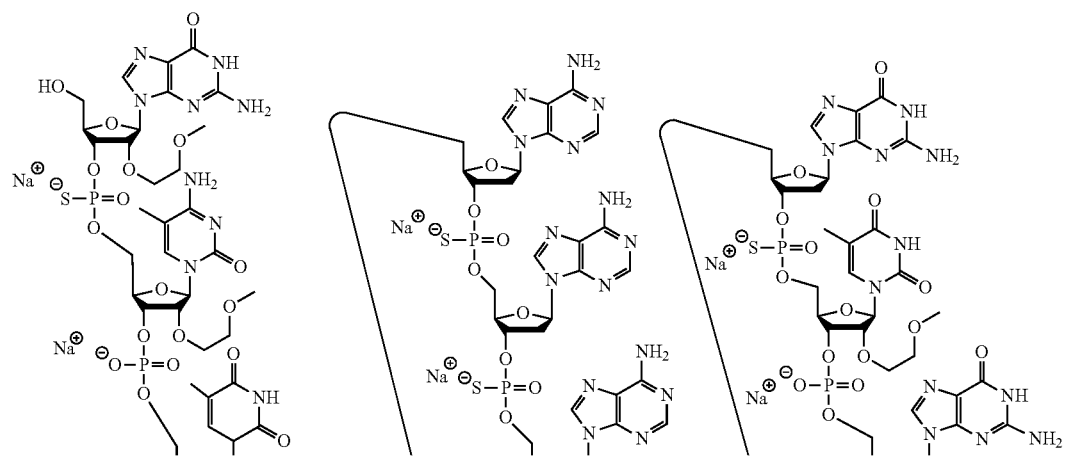

61
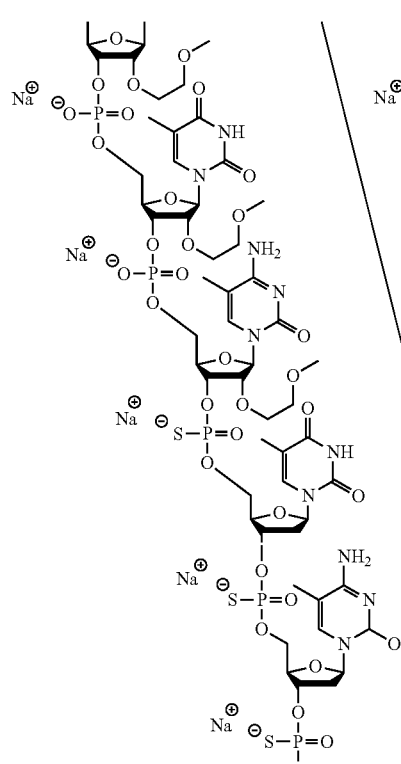
-continued
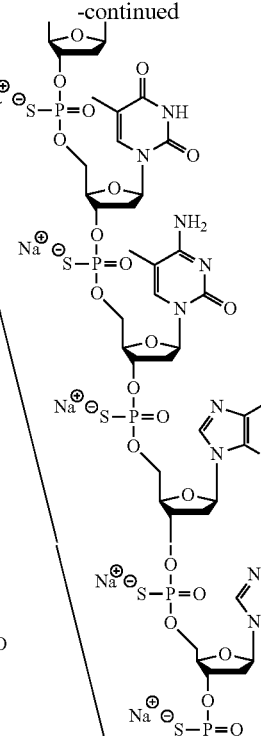
62
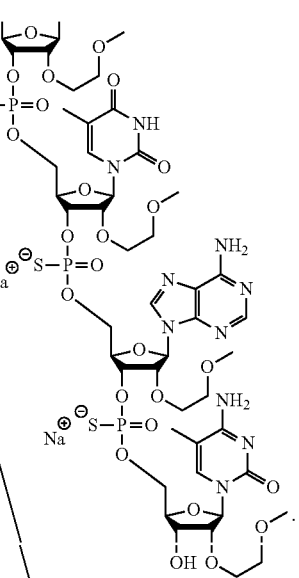
Embodiment 164. A modified oligonucleotide according to the following chemical structure:
(SEQ ID NO: 3673)
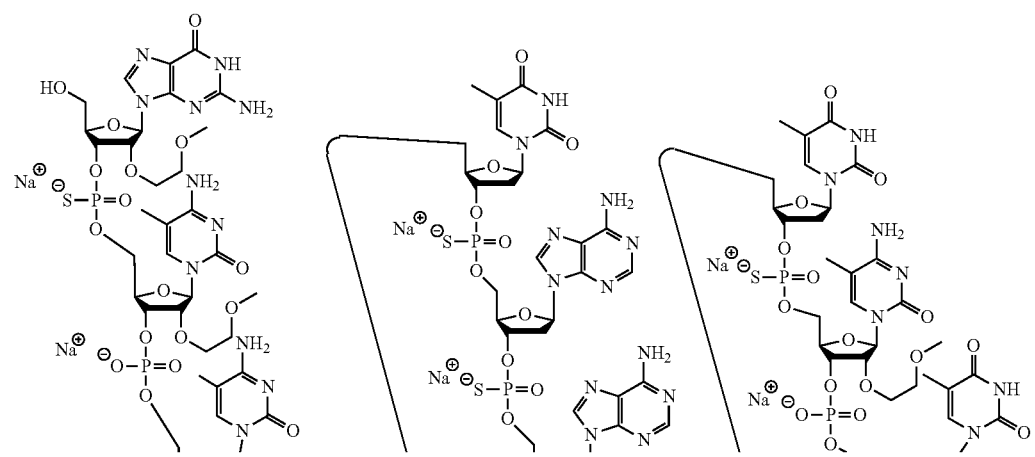

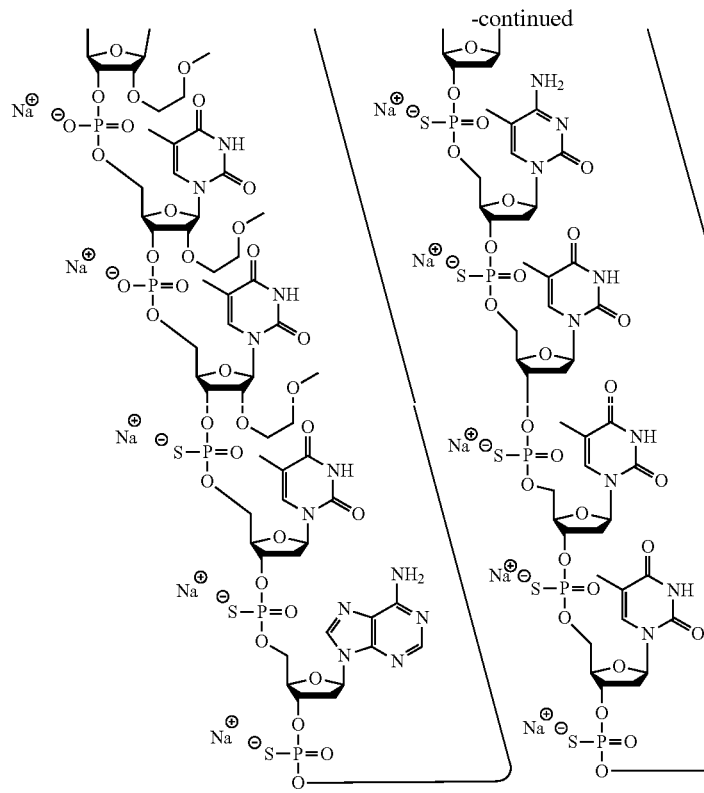
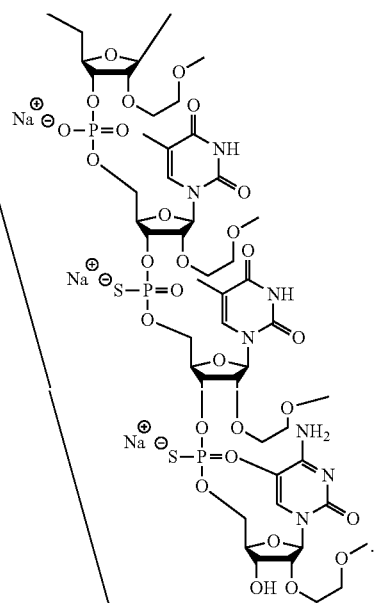
Embodiment 165. A modified oligonucleotide according to the following chemical structure:
(SEQ ID NO: 3674)
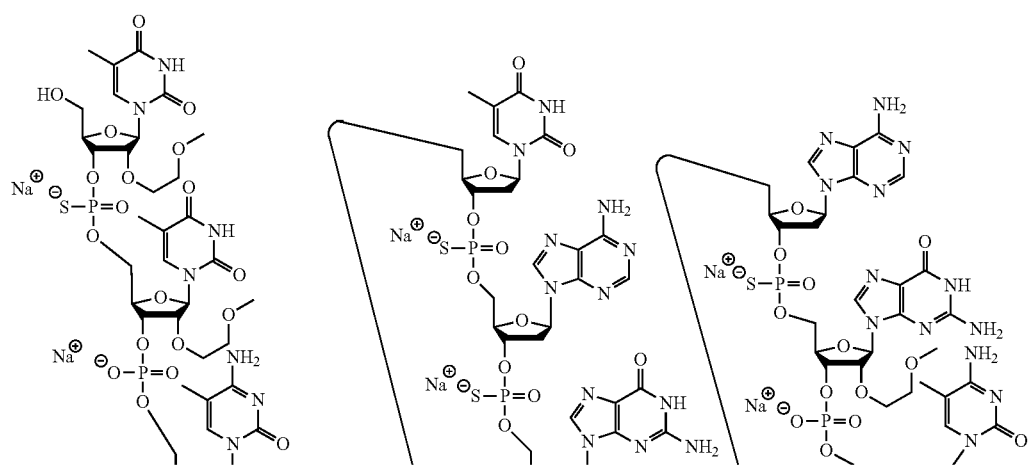

65 66
-continued
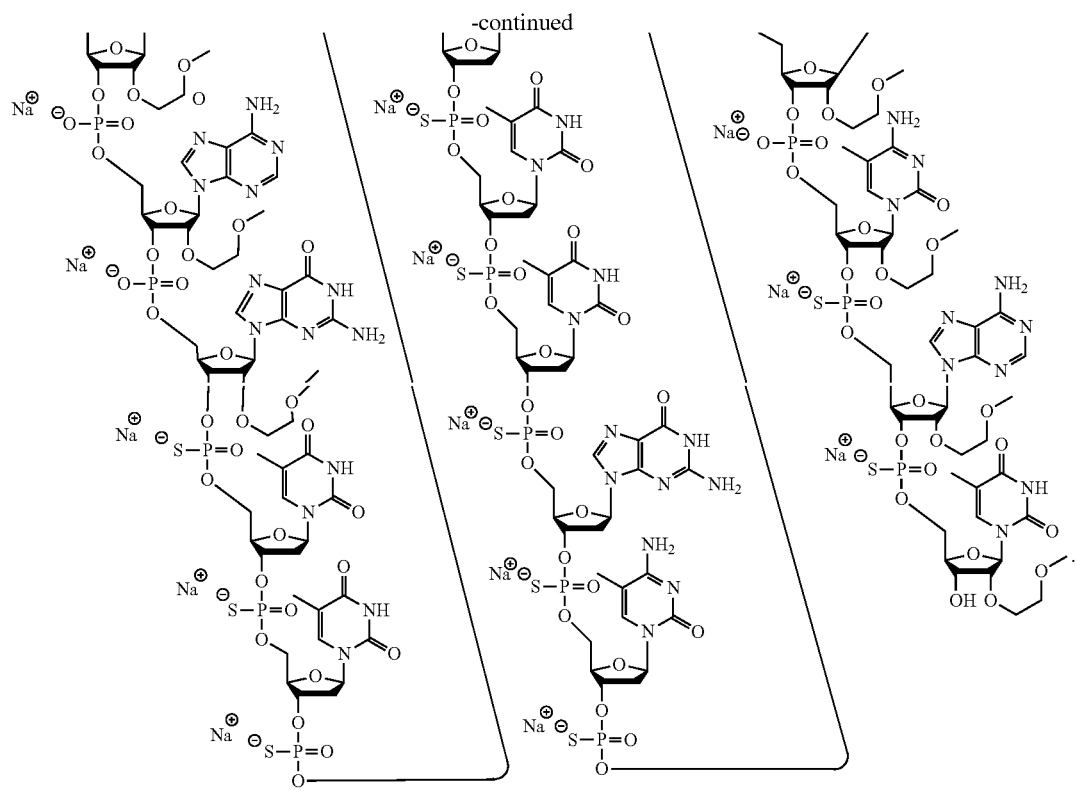
Embodiment 166. A modified oligonucleotide according to the following chemical structure:
(SEQ ID NO: 3670)
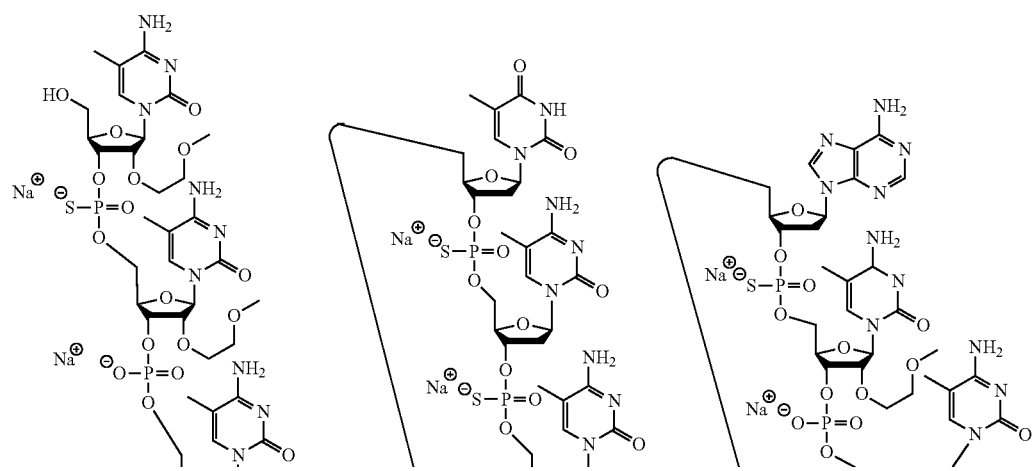

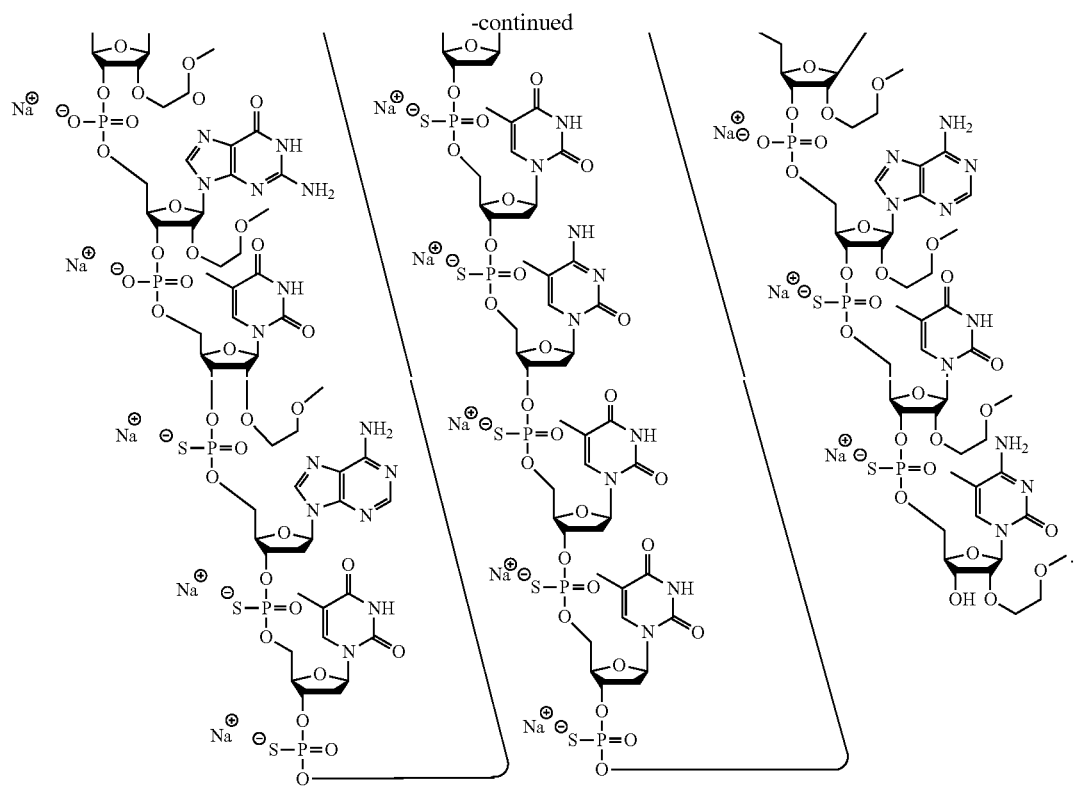
Embodiment 167. A modified oligonucleotide according to the following chemical structure:
(SEQ ID NO: 3675)
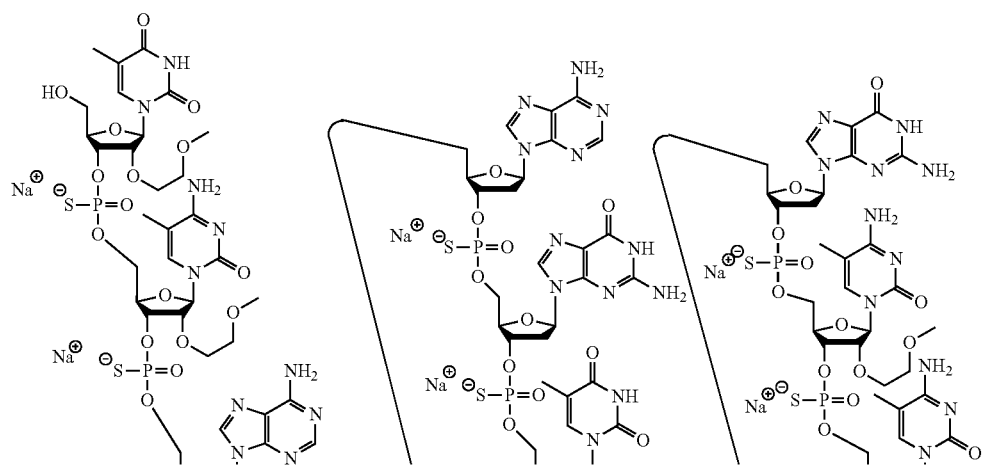

-continued

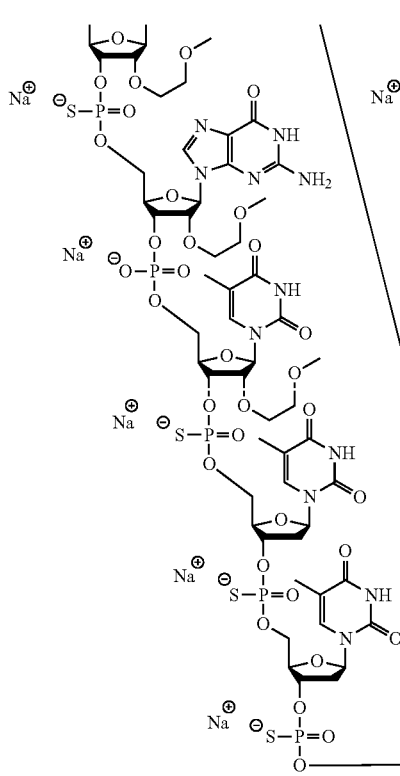
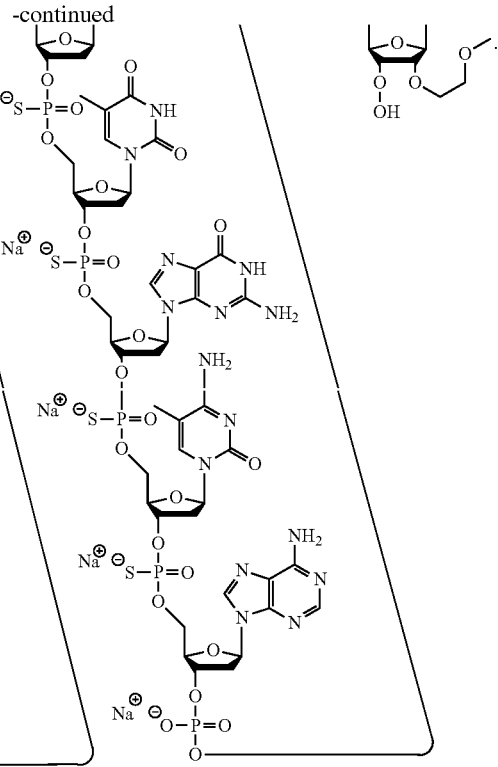

Embodiment 168. A chirally enriched population of oligomeric compounds of any of embodiments 87-154 or modified oligonucleotide of embodiments 155-167, wherein the population is enriched for modified oligonucleotides comprising at least one particular phosphorothioate internucleoside linkage having a particular stereochemical configuration.

Embodiment 169. The chirally enriched population of embodiment 168, wherein the population is enriched for modified oligonucleotides comprising at least one particular phosphorothioate internucleoside linkage having the (Sp) or (Rp) configuration.

Embodiment 170. The chirally enriched population of embodiment 169, wherein the population is enriched for modified oligonucleotides having a particular, independently selected stereochemical configuration at each phosphorothioate internucleoside linkage.

Embodiment 171. The chirally enriched population of embodiment 170, wherein the population is enriched for modified oligonucleotides having the (Rp) configuration at one particular phosphorothioate internucleoside linkage and the (Sp) configuration at each of the remaining phosphorothioate internucleoside linkages.

Embodiment 172. The chirally enriched population of embodiment 171, wherein the population is enriched for modified oligonucleotides having at least 3 contiguous phosphorothioate internucleoside linkages in the Sp, Sp, and Rp configurations, in the 5' to 3' direction.

Embodiment 173. A population of oligomeric compounds comprising modified oligonucleotides of any of embodiments 87-154, or a population of modified oligonucleotides of embodiments 155-167, wherein all of the phosphorothioate internucleoside linkages of the modified oligonucleotide are stereorandom.

Embodiment 174. An oligomeric duplex, comprising a first oligomeric compound and a second oligomeric compound comprising a second modified oligonucleotide, wherein the first oligomeric compound is an oligomeric compound of any of embodiments 87-154.

Embodiment 175. The oligomeric duplex of embodiment 174, wherein the second oligomeric compound comprises a second modified oligonucleotide consisting of 12 to 30 linked nucleosides, and wherein the nucleobase sequence of the second modified oligonucleotide comprises a complementary region of at least 8 nucleobases that is at least 90% complementary to an equal length portion of the first modified oligonucleotide.

Embodiment 176. The oligomeric duplex of embodiment 174 or 175, wherein the modified oligonucleotide of the first oligomeric compound comprises a 5'-stabilized phosphate group.

Embodiment 177. The oligomeric duplex of embodiment 176, wherein the stabilized phosphate group comprises a cyclopropyl phosphonate or a vinyl phosphonate.

Embodiment 178. The oligomeric duplex of any of embodiments 174-177, wherein the modified oligonucleotide of the first oligomeric compound comprises a glycol nucleic acid (GNA) sugar surrogate.

Embodiment 179. The oligomeric duplex of any of embodiments 174-178, wherein the modified oligonucleotide of the first oligomeric compound comprises a 2'-NMA sugar moiety.

Embodiment 180. The oligomeric duplex of any of embodiments 174-179, wherein at least one nucleoside of the second modified oligonucleotide comprises a modified sugar moiety.

Embodiment 181. The oligomeric duplex of embodiment 180, wherein the modified sugar moiety of the second modified oligonucleotide comprises a bicyclic sugar moiety.

Embodiment 182. The oligomeric duplex of embodiment 181, wherein the bicyclic sugar moiety of the second modified oligonucleotide comprises a 2'-4' bridge selected from —O—CH$_2$—; and —O—CH(CH$_3$)—.

Embodiment 183. The oligomeric duplex of embodiment 182, wherein the modified sugar moiety of the second modified oligonucleotide comprises a non-bicyclic modified sugar moiety.

Embodiment 184. The oligomeric duplex of embodiment 183, wherein the non-bicyclic modified sugar moiety of the second modified oligonucleotide is a 2'-MOE sugar moiety, a 2'-F sugar moiety, or 2'-OMe sugar moiety.

Embodiment 185. The oligomeric duplex of any of embodiments 174-184, wherein at least one nucleoside of the second modified oligonucleotide comprises a sugar surrogate.

Embodiment 186. The oligomeric duplex of any of embodiments 174-185, wherein at least one internucleoside linkage of the second modified oligonucleotide is a modified internucleoside linkage.

Embodiment 187. The oligomeric duplex of embodiment 186, wherein at least one modified internucleoside linkage of the second modified oligonucleotide is a phosphorothioate internucleoside linkage.

Embodiment 188. The oligomeric duplex of any of embodiments 174-187, wherein at least one internucleoside linkage of the second modified oligonucleotide is a phosphodiester internucleoside linkage.

Embodiment 189. The oligomeric duplex of any of embodiments 174-188, wherein each internucleoside linkage of the second modified oligonucleotide is independently selected from a phosphodiester or a phosphorothioate internucleoside linkage.

Embodiment 190. The oligomeric duplex of any of embodiments 174-189, wherein each internucleoside linkage of the second modified oligonucleotide is independently selected from a phosphodiester internucleoside linkage, a phosphorothioate internucleoside linkage, or a mesyl phosphoramidate internucleoside linkage.

Embodiment 191. The oligomeric duplex of any of embodiments 174-190, wherein the second modified oligonucleotide comprises at least one modified nucleobase.

Embodiment 192. The oligomeric duplex of embodiment 191, wherein the modified nucleobase of the second modified oligonucleotide is 5-methylcytosine.

Embodiment 193. The oligomeric duplex of any of embodiments 174-192, wherein the second modified oligonucleotide comprises a conjugate group.

Embodiment 194. The oligomeric duplex of embodiment 193, wherein the conjugate group comprises a conjugate linker and a conjugate moiety.

Embodiment 195. The oligomeric duplex of embodiment 193 or 194, wherein the conjugate group is attached to the second modified oligonucleotide at the 5'-end of the second modified oligonucleotide.

Embodiment 196. The oligomeric duplex of embodiment 193 or 194, wherein the conjugate group is attached to the second modified oligonucleotide at the 3'-end of the modified oligonucleotide.

Embodiment 197. The oligomeric duplex of any of embodiments 193-196, wherein the second modified oligonucleotide comprises a terminal group.

Embodiment 198. The oligomeric duplex of embodiment 197, wherein the terminal group is an abasic sugar moiety.

Embodiment 199. The oligomeric duplex of any of embodiments 174-198, wherein the second modified oligonucleotide consists of 10 to 25, 10 to 30, 10 to 50, 12 to 20, 12 to 25, 12 to 30, 12 to 50, 13 to 20, 13 to 25, 13 to 30, 13 to 50, 14 to 20, 14 to 25, 14 to 30, 14 to 50, 15 to 20, 15 to 25, 15 to 30, 15 to 50, 16 to 18, 16 to 20, 16 to 25, 16 to 30, 16 to 50, 17 to 20, 17 to 25, 17 to 30, 17 to 50, 18 to 20, 18 to 25, 18 to 30, 18 to 50, 19 to 19 to 25, 19 to 30, 19 to 50, 20 to 25, 20 to 30, 20 to 50, 21 to 25, 21 to 30, 21 to 50, 22 to 25, 22 to 30, 22 to 50, 23 to 25, 23 to 30, or 23 to 50 linked nucleosides.

Embodiment 200. An antisense agent comprising an antisense compound, wherein the antisense compound is the oligomeric compound of any of embodiments 87-154 or the modified oligonucleotide of any of embodiments 155-167.

Embodiment 201. The antisense agent of embodiment 200, wherein the antisense agent is the oligomeric duplex of any of embodiments 174-199.

Embodiment 202. The antisense agent of embodiment 200 or 201, wherein the antisense agent is an RNase H agent capable of reducing the amount of ATXN1 nucleic acid through the activation of RNase H.

Embodiment 203. The antisense agent of any of embodiments 200-202, wherein the conjugate group comprises a cell-targeting moiety.

Embodiment 204. A pharmaceutical composition comprising an oligomeric compound of any of embodiments 87-154, the modified oligonucleotide of any of embodiments 155-167, the population of any of embodiments 168-173, an oligomeric duplex of any of embodiments 174-199, or an antisense agent of any of embodiments 200-203, and a pharmaceutically acceptable carrier or diluent.

Embodiment 205. The pharmaceutical composition of embodiment 204, wherein the pharmaceutically acceptable diluent is water, phosphate-buffered saline, or artificial cerebral spinal fluid.

Embodiment 206. The pharmaceutical composition of embodiment 205, wherein the pharmaceutical composition consists essentially of the modified oligonucleotide and artificial cerebral spinal fluid.

Embodiment 207. A method comprising administering to a subject the oligomeric compound of any of embodiments 87-154, the modified oligonucleotide of any of embodiments 155-167, the population of any of embodiments 168-173, the oligomeric duplex of any of embodiments 174-199, the antisense agent of any of embodiments 200-203, or the pharmaceutical composition of any of embodiments 204-206.

Embodiment 208. A method of treating a disease associated with ATXN1 comprising administering to a subject having a disease associated with ATXN1 a therapeutically effective amount of the oligomeric compound of any of embodiments 87-154, the modified oligonucleotide of any of embodiments 155-167, the population of any of embodiments 168-173, the oligomeric duplex of any of embodiments 174-199, the antisense agent of any of embodiments 200-203, or the pharmaceutical composition of any of embodiments 204-206; thereby treating the disease associated with ATXN1.

Embodiment 209. The method of embodiment 208, wherein the ATXN1-associated disease is Spinocerebellar ataxia type 1.

Embodiment 210. The method of any of embodiments 208-209, wherein at least one symptom or hallmark of the ATXN1-associated disease is ameliorated.

Embodiment 211. The method of embodiment 210, wherein the symptom or hallmark is gait or limb ataxia, cognitive impairments, difficulty with speaking or swallowing, atrophy of the cerebellum and/or brainstem in magnetic resonance imaging (MRI), neurochemical abnormalities in the cerebellum and/or brainstem detected via magnetic resonance spectroscopy (MRS), or death within 10-15 years of symptom onset.

Embodiment 212. The method of any of embodiments 208-211, wherein ATXN1 levels in the subject are reduced.

Embodiment 213. A method of reducing expression of ATXN1 in a cell comprising contacting the cell with the oligomeric compound of any of embodiments 87-154, the modified oligonucleotide of any of embodiments 155-167, the population of any of embodiments 168-173, the oligomeric duplex of any of embodiments 174-199, the antisense agent of any of embodiments 200-203, or the pharmaceutical composition of any of embodiments 204-206.

Embodiment 214. The method of embodiment 213, wherein the cell is a CNS cell.

Embodiment 215. Use of the oligomeric compound of any of embodiments 87-154, the modified oligonucleotide of any of embodiments 155-167, the population of any of embodiments 168-173, the oligomeric duplex of any of embodiments 174-199, the antisense agent of any of embodiments 200-203, or the pharmaceutical composition of any of embodiments 204-206 for treating a disease associated with ATXN1.

Embodiment 216. Use of the oligomeric compound of any of embodiments 87-154, the modified oligonucleotide of any of embodiments 155-167, the population of any of embodiments 168-173, the oligomeric duplex of any of embodiments 174-199, the antisense agent of any of embodiments 200-203, or the pharmaceutical composition of any of embodiments 204-206 in the manufacture of a medicament for treating a disease associated with ATXN1.

Embodiment 217. The use of embodiment 215 or 216, wherein the disease associated with ATXN1 is Spinocerebellar ataxia type 1.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE" or "O-methoxyethyl"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted non-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside non-bicyclic modified nucleoside comprises a sugar moiety comprising a non-bridging 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted nucleoside comprises a sugar moiety comprising a non-bridging 2'-substituent group selected from: F, OCH$_3$, and OCH$_2$CH$_2$OCH$_3$.

In certain embodiments, modified furanosyl sugar moieties and nucleosides incorporating such modified furanosyl sugar moieties are further defined by isomeric configuration. For example, a 2'-deoxyfuranosyl sugar moiety may be in seven isomeric configurations other than the naturally occurring β-D-deoxyribosyl configuration. Such modified sugar moieties are described in, e.g., WO 2019/157531, incorporated by reference herein. A 2'-modified sugar moiety has an additional stereocenter at the 2'-position relative to a 2'-deoxyfuranosyl sugar moiety; therefore, such sugar moieties have a total of sixteen possible isomeric configurations. 2'-modified sugar moieties described herein are in the β-D-ribosyl isomeric configuration unless otherwise specified.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt"), 4'-CH$_2$—O—CH$_2$-2', 4'- CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., *J. Org. Chem.*, 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O- 2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129, 8362-8379; Wengel et al., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

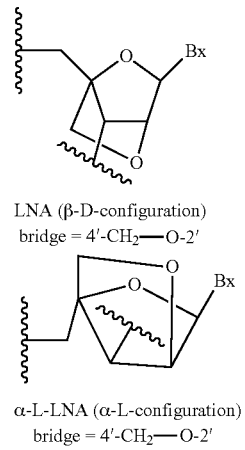

LNA (β-D-configuration)
bridge = 4'-CH$_2$—O-2'

α-L-LNA (α-L-configuration)
bridge = 4'-CH$_2$—O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("NINA") (see, e.g., Leumann, CJ. *Bioorg. & Med. Chem.* 2002, 10, 841-854), fluoro HNA:

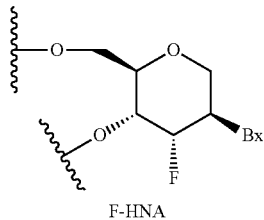

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

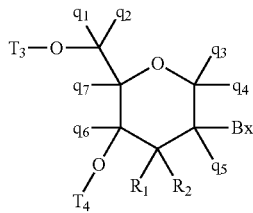

wherein, independently, for each of the modified THP nucleosides:
  Bx is a nucleobase moiety;
  $T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;
  $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and
    each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

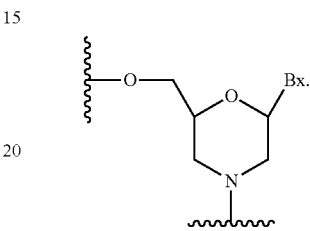

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.*, 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleosides comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH₃) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deazaadenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphodiesters, which contain a phosphodiester bond ("P(O$_2$)=O") (also referred to as unmodified or naturally occurring linkages), phosphotriesters, methylphosphonates, phosphoramidates, and phosphorothioates ("P(O$_2$)=S"), and phosphorodithioates ("HS—P=S"). Representative non-phosphorus containing internucleoside linking groups include but are not limited to methylenemethylimino (—CH$_2$—N(CH$_3$)—O—CH$_2$—), thiodiester, thionocarbamate (—O—C(=O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphodiester internucleoside linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkage in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACCS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

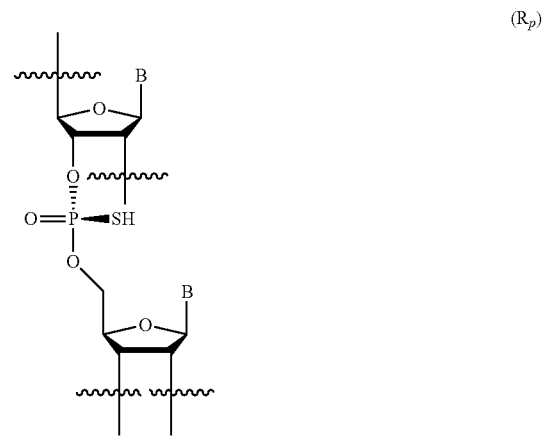

(R$_p$)

-continued

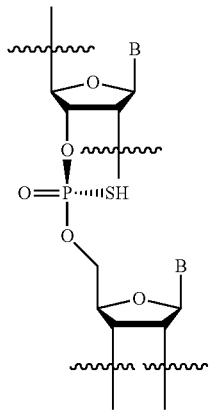

(S$_p$)

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-CH$_2$—N(CH$_3$)—O-5'), amide-3 (3'-CH$_2$—C(=O)—N(H)-5'), amide-4 (3'-CH$_2$—N(H)—C(=O)-5'), formacetal (3'-O—CH$_2$—O-5'), methoxypropyl (MOP), and thioformacetal (3'-S—CH$_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and CH$_2$ component parts. In certain embodiments, a neutral internucleoside linkage is any of those described in WO 2021/030778, incorporated by reference herein.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or portion thereof in a defined pattern or sugar motif. In certain instances, such sugar motifs include but are not limited to any of the sugar modifications discussed herein.

In certain embodiments, modified oligonucleotides have a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-6 nucleosides. In certain embodiments, each nucleoside of each wing of a gapmer comprises a modified sugar moiety. In certain embodiments, at least one nucleoside of each wing of a gapmer comprises a modified sugar moiety. In certain embodiments, at least two nucleosides of each wing of a gapmer comprises a modified sugar moiety. In certain embodiments, at least three nucleosides of each wing of a gapmer comprises a modified sugar moiety. In certain embodiments, at least four nucleosides of each wing of a gapmer comprises a modified sugar moiety. In certain embodiments, at least five nucleosides of each wing of a gapmer comprises a modified sugar moiety.

In certain embodiments, the gap of a gapmer comprises 7-12 nucleosides. In certain embodiments, each nucleoside of the gap of a gapmer comprises a 2'-deoxyribosyl sugar moiety. In certain embodiments, each nucleoside of the gap of a gapmer comprises a 2'-β-D-deoxyribosyl sugar moiety. In certain embodiments, at least one nucleoside of the gap of a gapmer comprises a modified sugar moiety. In certain embodiments, at least one nucleoside of the gap of a gapmer comprises a 2'-OMe sugar moiety.

In certain embodiments, the gapmer is a deoxy gapmer. In certain embodiments, the nucleosides on the gap side of each wing/gap junction comprise 2'-deoxyribosyl sugar moieties and the nucleosides on the wing sides of each wing/gap junction comprise modified sugar moieties. In certain embodiments, each nucleoside of the gap comprises a 2'-deoxyribosyl sugar moiety. In certain embodiments, each nucleoside of each wing of a gapmer comprises a modified sugar moiety. In certain embodiments, one nucleoside of the gap comprises a modified sugar moiety and each remaining nucleoside of the gap comprises a 2'-deoxyribosyl sugar moiety.

In certain embodiments, modified oligonucleotides comprise or consist of a portion having a fully modified sugar motif. In such embodiments, each nucleoside of the fully modified portion of the modified oligonucleotide comprises a modified sugar moiety. In certain embodiments, each nucleoside of the entire modified oligonucleotide comprises a modified sugar moiety. In certain embodiments, modified oligonucleotides comprise or consist of a portion having a fully modified sugar motif, wherein each nucleoside within the fully modified portion comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified oligonucleotide comprises the same 2'-modification.

Herein, the lengths (number of nucleosides) of the three regions of a gapmer may be provided using the notation [#of nucleosides in the 5'-wing]–[#of nucleosides in the gap]–[#of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprises a 2'-β-D-deoxyribosyl sugar moiety. Thus, a 5-10-5 MOE gapmer consists of 5 linked 2'-MOE nucleosides in the 5'-wing, 10 linked a 2'-β-D-deoxynucleosides in the gap, and 5 linked 2'-MOE nucleosides in the 3'-wing. A 3-10-3 cEt gapmer consists of 3 linked cEt nucleosides in the 5'-wing, 10 linked 2'-β-D-deoxynucleosides in the gap, and 3 linked cEt nucleosides in the 3'-wing. A 5-8-5 gapmer consists of 5 linked nucleosides comprising a modified sugar moiety in the 5'-wing, 8 linked a 2'-β-D-deoxynucleosides in the gap, and 5 linked nucleosides comprising a modified sugar moiety in the 3'-wing. A 5-8-5 or 5-8-4 mixed wing gapmer has at least two different modified sugar moieties in the 5'- and/or the 3'-wing.

In certain embodiments, modified oligonucleotides are 5-10-5 MOE gapmers. In certain embodiments, modified oligonucleotides are 6-10-4 MOE gapmers. In certain embodiments, modified oligonucleotides are 5-8-4 MOE gapmers. In certain embodiments, modified oligonucleotides are X—Y—Z MOE gapmers, wherein X and Z are independently selected from 1, 2, 3, 4, 5, 6, or 7 linked 2'-MOE nucleosides and Y is selected from 7, 8, 9, 10, or 11. linked deoxynucleosides.

In certain embodiments, modified oligonucleotides have a sugar motif selected from the following (5' to 3'): eeeeeddddddddkkee or eeeeedyddddddkkee, wherein 'd' represents a 2'-deoxyribosyl sugar moiety, 'e' represents a 2'-MOE sugar moiety, 'k' represents a cEt sugar moiety, and 'y' represents a 2'-OMe sugar moiety.

2. Certain Nucleobase Motifs

In certain embodiments, oligonucleotides comprise modified and/or unmodified nucleobases arranged along the oligonucleotide or portion thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl sugar moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or portion thereof in a defined pattern or motif. In certain embodiments, each internucleoside linking group is a phosphodiester internucleoside linkage ($P(O_2)=O$). In certain embodiments, each internucleoside linking group of a modified oligonucleotide is a phosphorothioate internucleoside linkage ($P(O_2)=S$). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, all of the internucleoside linkages are either phosphodiester internucleoside linkages or phosphorothioate internucleoside linkages, and the chiral motif is (5' to 3'): Sp-o-o-o-Sp-Sp-Sp-Rp-Sp-Sp-Rp-Sp-Sp-Sp-Sp-Sp-Sp-Sp-Sp or Sp-o-o-o-Sp-Sp-Sp-Rp-Sp-Sp-Sp-Sp-Sp-Sp-Sp-Sp-Sp-Sp, wherein each 'Sp' represents a (Sp) phosphorothioate internucleoside linkage, each 'Rp' is a Rp internucleoside linkage, and each 'o' represents a phosphodiester internucleoside linkage. In certain embodiments, populations of modified oligonucleotides are enriched for modified oligonucleotides comprising such internucleoside linkage motifs.

In certain embodiments, modified oligonucleotides have an internucleoside linkage motif of sooossssssssssssooss, wherein each "s" represents a phosphorothioate internucleoside linkage and each "o" represents a phosphodiester internucleoside linkage. In certain embodiments, modified oligonucleotides have an internucleoside linkage motif of (5' to 3'): sooooossssssssssoss, wherein each "s" represents a phosphorothioate internucleoside linkage and each "o" represents a phosphodiester internucleoside linkage. In certain embodiments, modified oligonucleotides have an internucleoside linkage motif of (5' to 3'): sssosssssssssssosss, wherein each "s" represents a phosphorothioate internucleoside linkage and each "o" represents a phosphodiester internucleoside linkage. In certain embodiments, modified oligonucleotides have an internucleoside linkage motif of (5' to 3'): sssosssssssssssoss, wherein each "s" represents a phosphorothioate internucleoside linkage and each "o" represents a phosphodiester internucleoside linkage.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target nucleic acid in an oocyte injection model. Oligonucleotides 25 nucleobases in length with 8 or 11 mismatch bases near the ends of the oligonucleotides were able to direct specific cleavage of the target nucleic acid, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a portion of an oligonucleotide has a nucleobase sequence that is complementary to a second oligonucleotide or an identified reference nucleic acid, such as a target nucleic acid. In certain embodiments, the nucleobase sequence of a portion or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N.Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoaras et al., *EMBO J.*, 1991, 10, 1111-1118; Kabanov et al., *FEBS Lett.*, 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic acid a palmityl moiety (Mishra et al., *Biochim. Biophys. Acta*, 1995, 1264, 229-237), an octadecylamine or hexylamino-carbonyl-oxycholesterol moiety (Crooke et al., *J. Pharmacol. Exp. Ther.*, 1996, 277, 923-937), a tocopherol group (Nishina et al., *Molecular Therapy Nucleic Acids*, 2015, 4, e220; and Nishina et al., *Molecular Therapy*, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, lipophilic groups, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate or phosphodiester linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxynucleoside that is attached to either the 3' or 5'-terminal nucleoside of an oligonucleotide by a phosphodiester internucleoside linkage and covalently attached to the remainder of the conjugate linker or conjugate moiety by a phosphate or phosphorothioate linkage. In certain such embodiments, the cleavable moiety is 2'-deoxyadenosine.

3. Cell-Targeting Moieties

In certain embodiments, a conjugate group comprises a cell-targeting moiety. In certain embodiments, a conjugate group has the general formula:

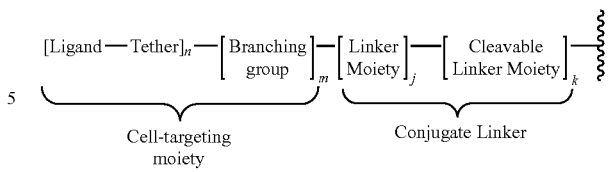

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphonates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a portion complementary to a target nucleic acid and a second oligomeric compound having a portion complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or subject.

V. Certain Target Nucleic Acids

In certain embodiments, oligomeric compounds comprise or consist of an oligonucleotide comprising a portion that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target nucleic acid is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a portion that is 100% or fully complementary to a target nucleic acid. In certain embodiments, the portion of full complementarity is 6, 7, 8, 9, 10, 11, 12, 13, 14, 15, 16, 17, 18, 19, 20, 21, 22, 23, or 24 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, 8, 9, 10, or 11 from the 5'-end of the gap region. In certain embodiments, the mismatch is at position 1, 2, 3, 4, 5, or 6 from the 5'-end of the 5' wing region or the 3' wing region.

B. ATXN1

In certain embodiments, oligomeric compounds comprise or consist of an oligonucleotide that is complementary to a target nucleic acid, wherein the target nucleic acid is an ATXN1 nucleic acid. In certain embodiments, ATXN1 nucleic acid has the sequence set forth in SEQ ID NO: 1 (GENBANK Accession No. NM_000332.3), SEQ ID NO: 2 (the complement of GENBANK Accession No. NC_000006.12 truncated from nucleotides 16296001 to 16764000), SEQ ID NO: 3 (GENBANK Accession No. NM_001128164.1), SEQ ID NO: 4 (GENBANK Accession No. BC011026.1), SEQ ID NO: 5 (GENBANK Accession No. BC029401.1), or SEQ ID NO: 6 (GENBANK Accession No. BC047894.1).

In certain embodiments, contacting a cell with an oligomeric compound complementary to any of SEQ ID NO: 1-6 reduces the amount of ATXN1 RNA in a cell. In certain embodiments, contacting a cell with an oligomeric compound complementary to any of SEQ ID NO: 1-6 reduces the amount of ATXN1 in a cell. In certain embodiments, the cell is in vitro. In certain embodiments, the cell is in a subject. In certain embodiments, the oligomeric compound consists of a modified oligonucleotide. In certain embodiments, contacting a cell in a subject with an oligomeric compound complementary to any of SEQ ID NO: 1-6 ameliorates one or more symptom or hallmark of a neurodegenerative disease. In certain embodiments, the neurodegenerative disease is SCA1. In certain embodiments, the symptom or hallmark is selected from gait and limb ataxia, cognitive impairments, difficulty with speaking and swallowing, atrophy of the cerebellum and brainstem in magnetic resonance imaging (MRI), neurochemical abnormalities in the cerebellum and brainstem detected via magnetic resonance spectroscopy (MRS), and death within 10-15 years of symptom onset.

In certain embodiments, an oligomeric compound complementary to any of SEQ ID NO: 1-6 is capable of reducing the detectable amount of ATXN1 RNA in vitro by at least 10%, at least 20%, at least 30%, at least 40%, at least 50%, at least 60%, at least 70%, at least 80%, or at least 90% when administered according to the standard cell assay. In certain embodiments, an oligomeric compound complementary to SEQ ID NO: 1, SEQ ID NO: 2, SEQ ID NO: 3, SEQ ID NO: 4, SEQ ID NO: 5, or SEQ ID NO: 6 is capable of decreasing the amount of ATXN1 in vitro by at least 10%, at least 20%, at least 30%, at least 40%, at least 50%, at least 60%, at least 70%, at least 80%, or at least 90% when administered according to the standard cell assay. In certain embodiments, an oligomeric compound complementary to SEQ ID NO: 1, SEQ ID NO: 2, SEQ ID NO: 3, SEQ ID NO: 4, SEQ ID NO: 5, or SEQ ID NO: 6 is capable of reducing the detectable amount of ATXN1 RNA in the CSF of a subject by at least 10%, at least 20%, at least 30%, at least 40%, at least 50%, at least 60%, at least 70%, at least 80%, or at least 90%. In certain embodiments, an oligomeric compound complementary to SEQ ID NO: 1, SEQ ID NO: 2, SEQ ID NO: 3, SEQ ID NO: 4, SEQ ID NO: 5, or SEQ ID NO: 6 is capable of decreasing the detectable amount of ATXN1 in the CSF of a subject by at least 10%, at least 20%, at least 30%, at least 40%, at least 50%, at least 60%, at least 70%, at least 80%, or at least 90%.

C. Certain Target Nucleic Acids in Certain Tissues

In certain embodiments, oligomeric compounds comprise or consist of an oligonucleotide comprising a portion that is complementary to a target nucleic acid, wherein the target nucleic acid is expressed in a pharmacologically relevant tissue. In certain embodiments, the pharmacologically relevant tissues are the cells and tissues that comprise the central nervous system. Such tissues include the cortex, cerebellum, and brainstem.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to a subject, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents comprising an oligomeric compound provided herein to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

VII. Certain Compositions

1. Compound No. 994509

In certain embodiments, Compound No. 994509 is characterized as a 5-10-5 MOE gapmer having a sequence of (from 5' to 3') GCACGGTATTAGTGTCTTCA (SEQ ID NO: 126), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 994509 is represented by the following chemical notation (5' to 3'):

(SEQ ID NO: 3671)
Ges ᵐCeo Aeo ᵐCeo Ges Gds Tds Ads Tds Tds Ads Gds Tds Gds Tds ᵐCeo Teo Tes ᵐCes Ae, wherein,
 A=an adenine nucleobase,
 ᵐC=a 5-methyl cytosine nucleobase,
 G=a guanine nucleobase,
 T=a thymine nucleobase,
 e=a 2'-MOE sugar moiety,
 d=a 2'-β-D deoxyribosyl sugar moiety,
 s=a phosphorothioate internucleoside linkage, and
 o=a phosphodiester internucleoside linkage.

In certain embodiments, Compound No. 994509 is represented by the following chemical structure:

(SEQ ID NO: 3671)

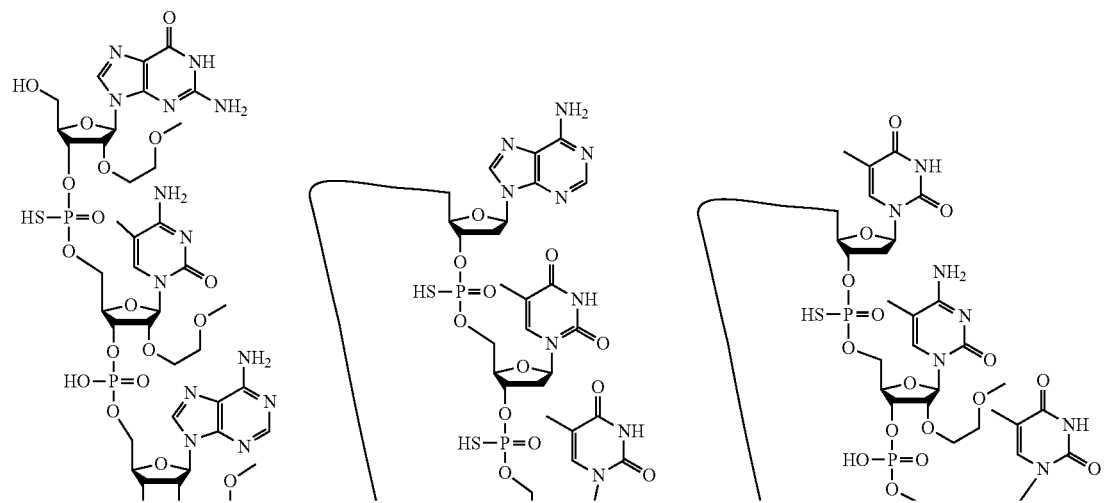

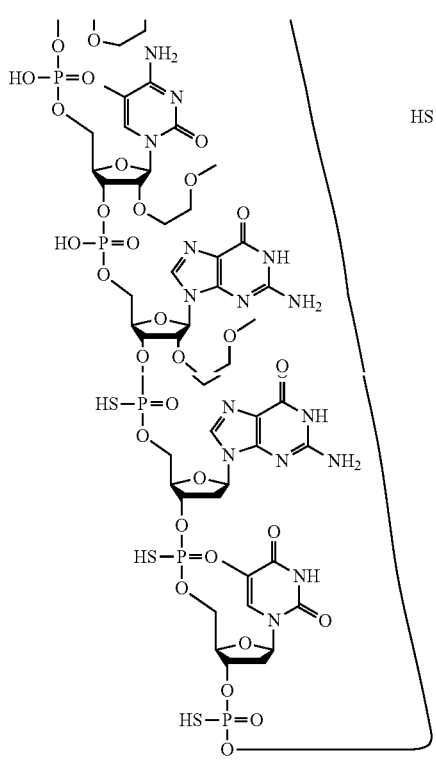
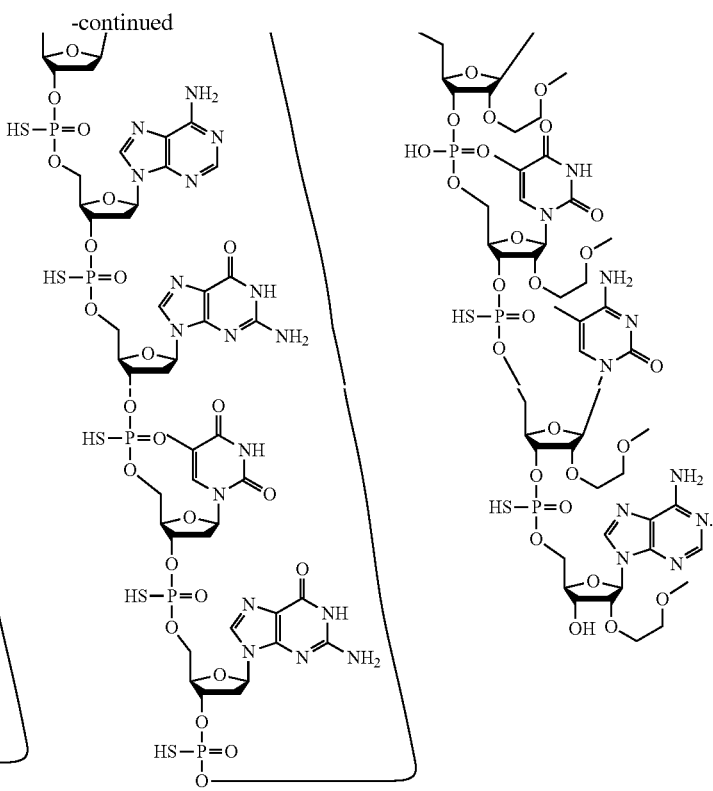
Structure 1. Compound No. 994509
In certain embodiments, the sodium salt of Compound No. 994509 is represented by the following chemical structure:
(SEQ ID NO: 3671)
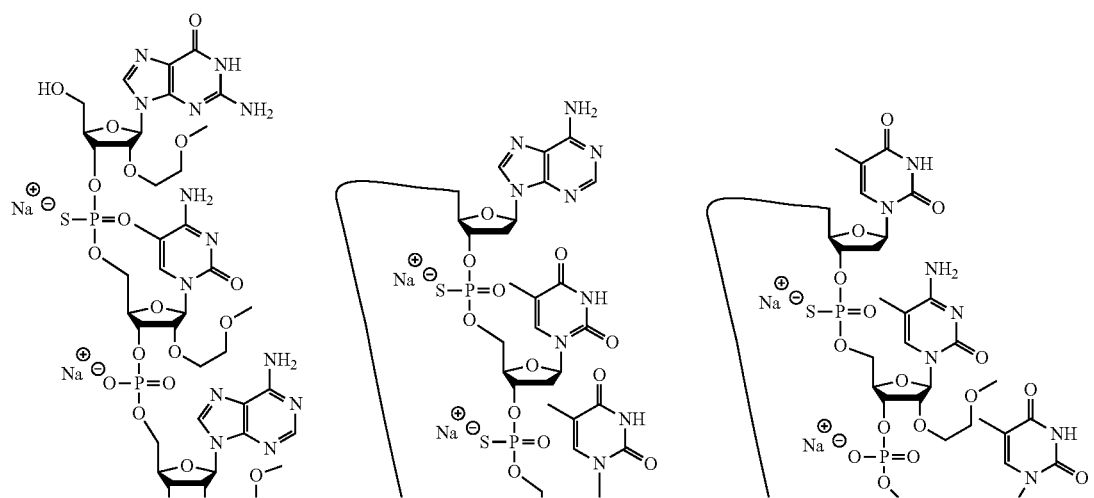

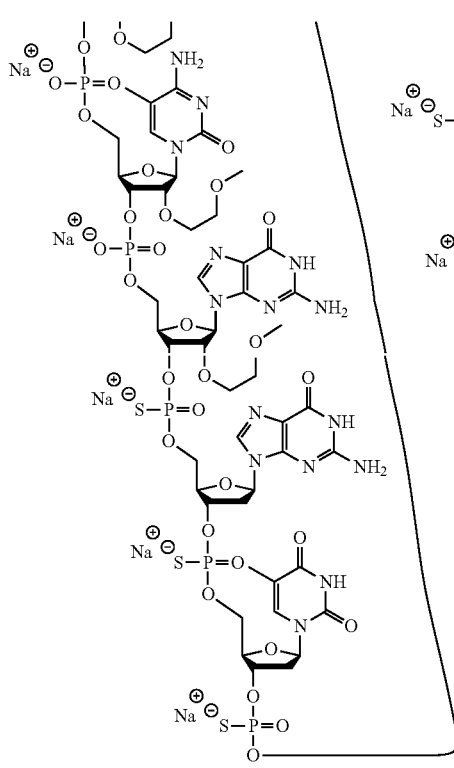
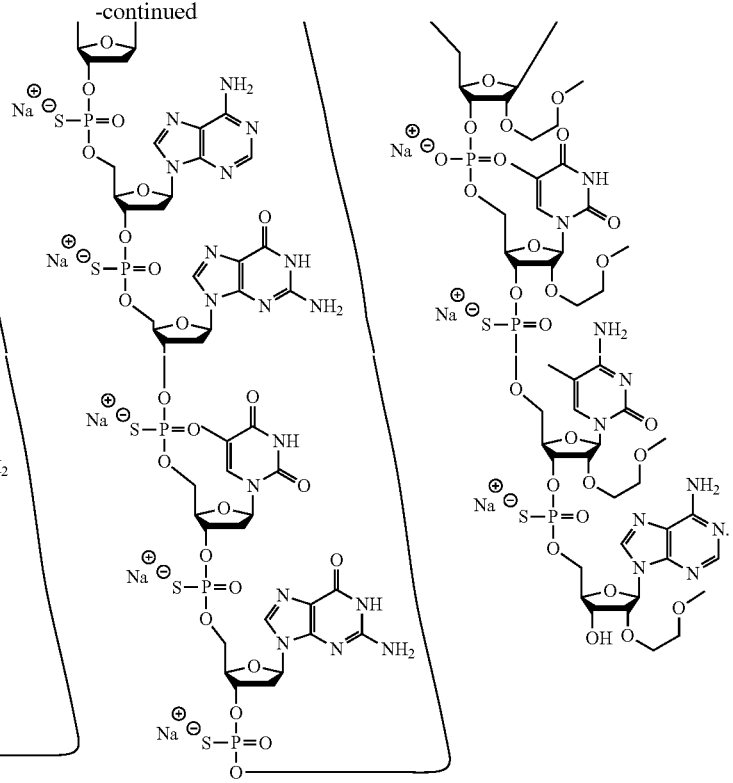

Structure 2. The Sodium Salt of Compound No. 994509

2. Compound No. 1040500

In certain embodiments, Compound No. 1040500 is characterized as a 5-10-5 MOE gapmer having a sequence of (from 5' to 3') GCTTCTCAAATCAGGTGTAC (SEQ ID NO: 1045), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1040500 is represented by the following chemical notation (5' to 3'):

(SEQ ID NO: 3672)
Ges $^m$Ceo Teo Teo $^m$Ces Tds $^m$Cds Ads Ads Ads Tds $^m$Cds Ads Gds Gds Teo Geo Tes Aes mCe, wherein, A=an adenine nucleobase, $^m$C=a 5-methyl cytosine nucleobase, G=a guanine nucleobase, T=a thymine nucleobase, e=a 2'-MOE sugar moiety, d=a 2'-β-D deoxyribosyl sugar moiety, s=a phosphorothioate internucleoside linkage, and o=a phosphodiester internucleoside linkage.

In certain embodiments, Compound No. 1040500 is represented by the following chemical structure:

(SEQ ID NO: 3672)
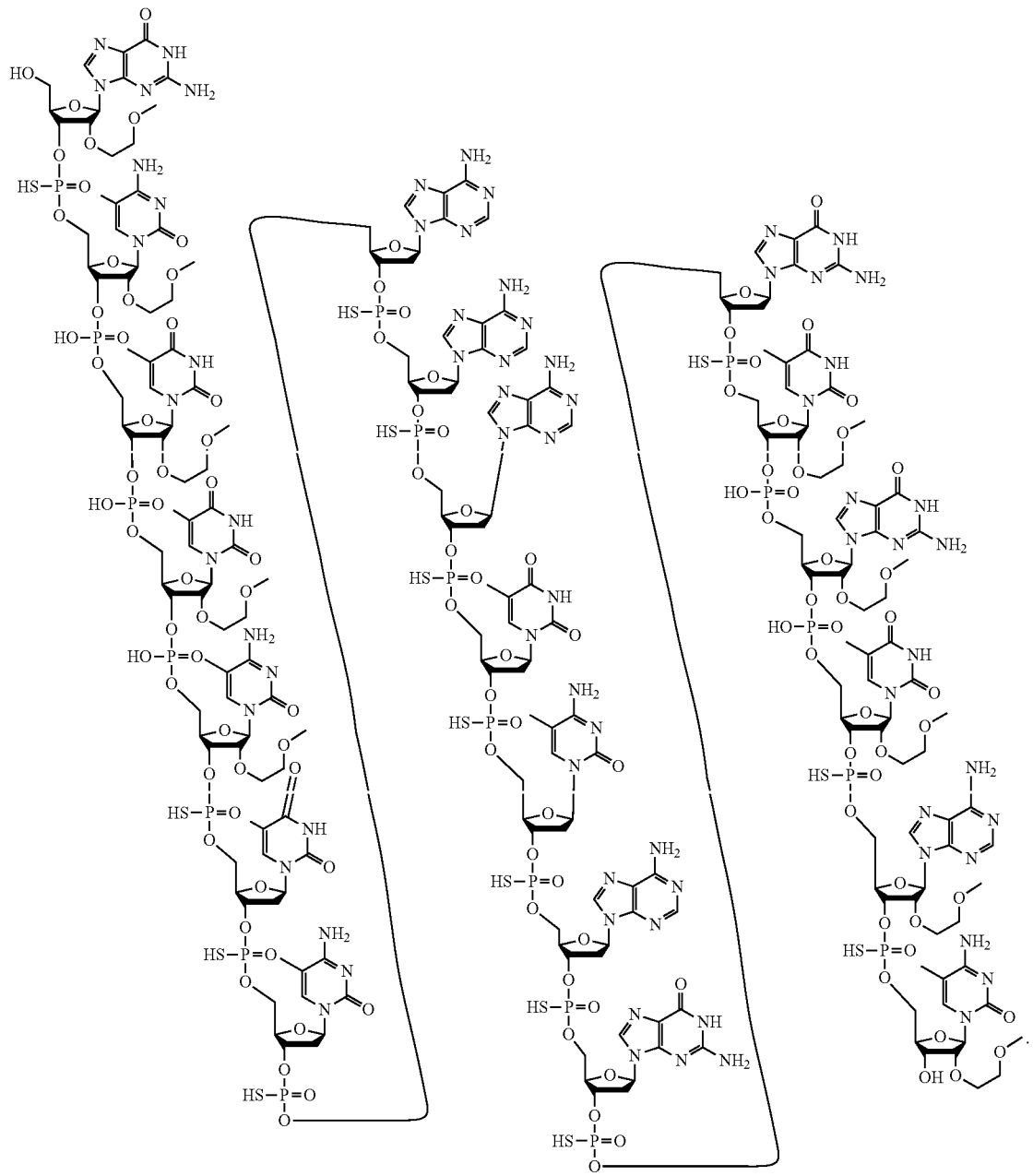
Structure 3. Compound No. 1040500
In certain embodiments, the sodium salt of Compound No. 1040500 is represented by the following chemical structure:

(SEQ ID NO: 3672)

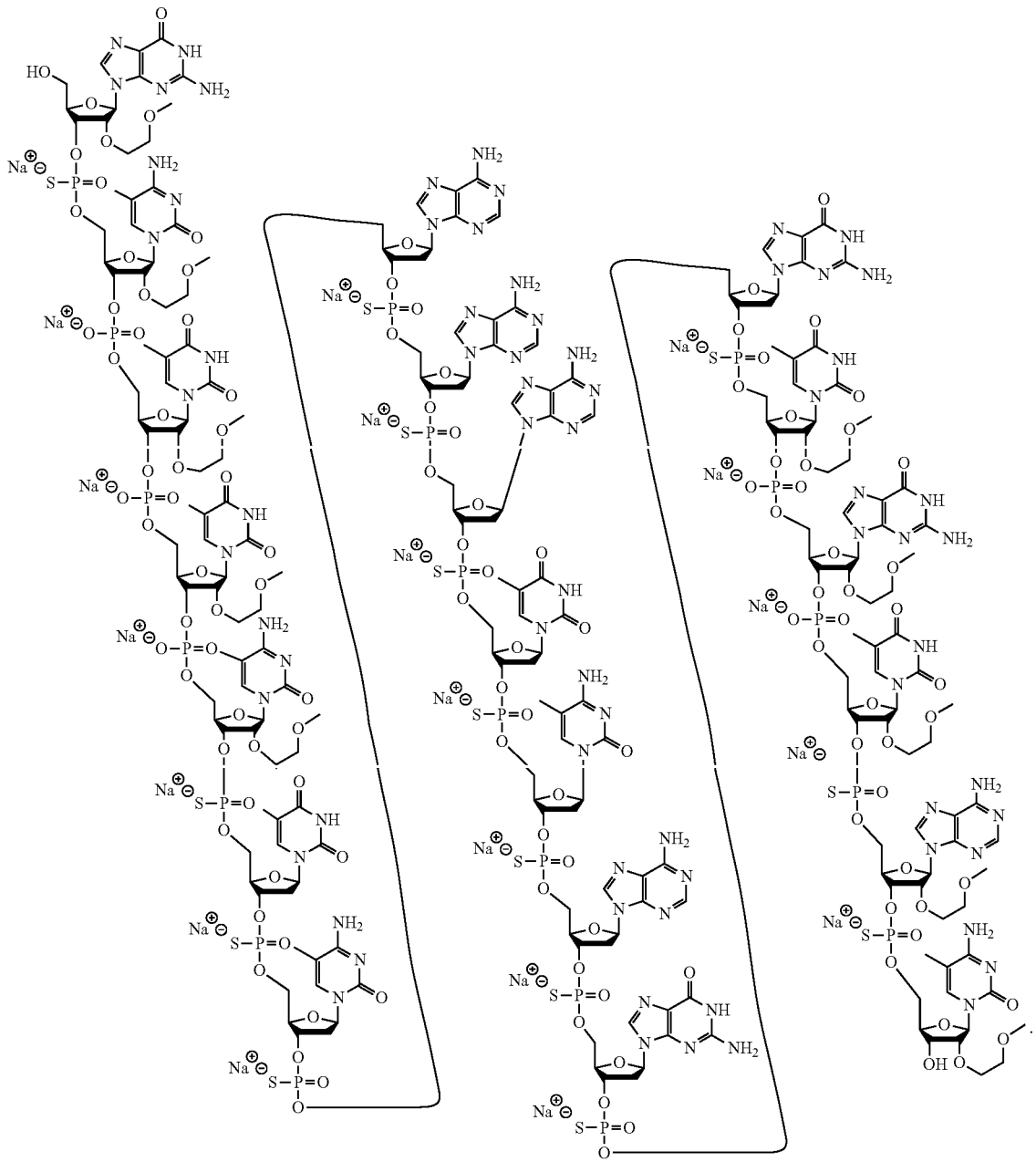

Structure 4. The Sodium Salt of Compound No. 1040500

3. Compound No. 1041927

In certain embodiments, Compound No. 1041927 is characterized as a 5-10-5 MOE gapmer having a sequence of (from 5' to 3') GCCTTTATAACTTTCTTTC (SEQ ID NO: 2552), wherein each of nucleosides 1-5 and 16-20 (from 5' to 3') are 2'-MOE nucleosides and each of nucleosides 6-15 are 2'-$3-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1041927 is represented by the following chemical notation (5' to 3'):

(SEQ ID NO: 3673)
Ges ᵐCeo ᵐCeo Teo Tes Tds Ads Tds Ads Ads ᵐCds

Tds Tds Tds Tds ᵐCeo Teo Tes Tes ᵐCe, wherein,
A=an adenine nucleobase,
ᵐC=a 5-methyl cytosine nucleobase,
G=a guanine nucleobase,
T=a thymine nucleobase,
e=a 2'-MOE sugar moiety, d=a 2'-β-D deoxyribosyl sugar moiety,
s=a phosphorothioate internucleoside linkage, and
o=a phosphodiester internucleoside linkage.

In certain embodiments, Compound No. 1041927 is represented by the following chemical structure:

(SEQ ID NO: 3673)

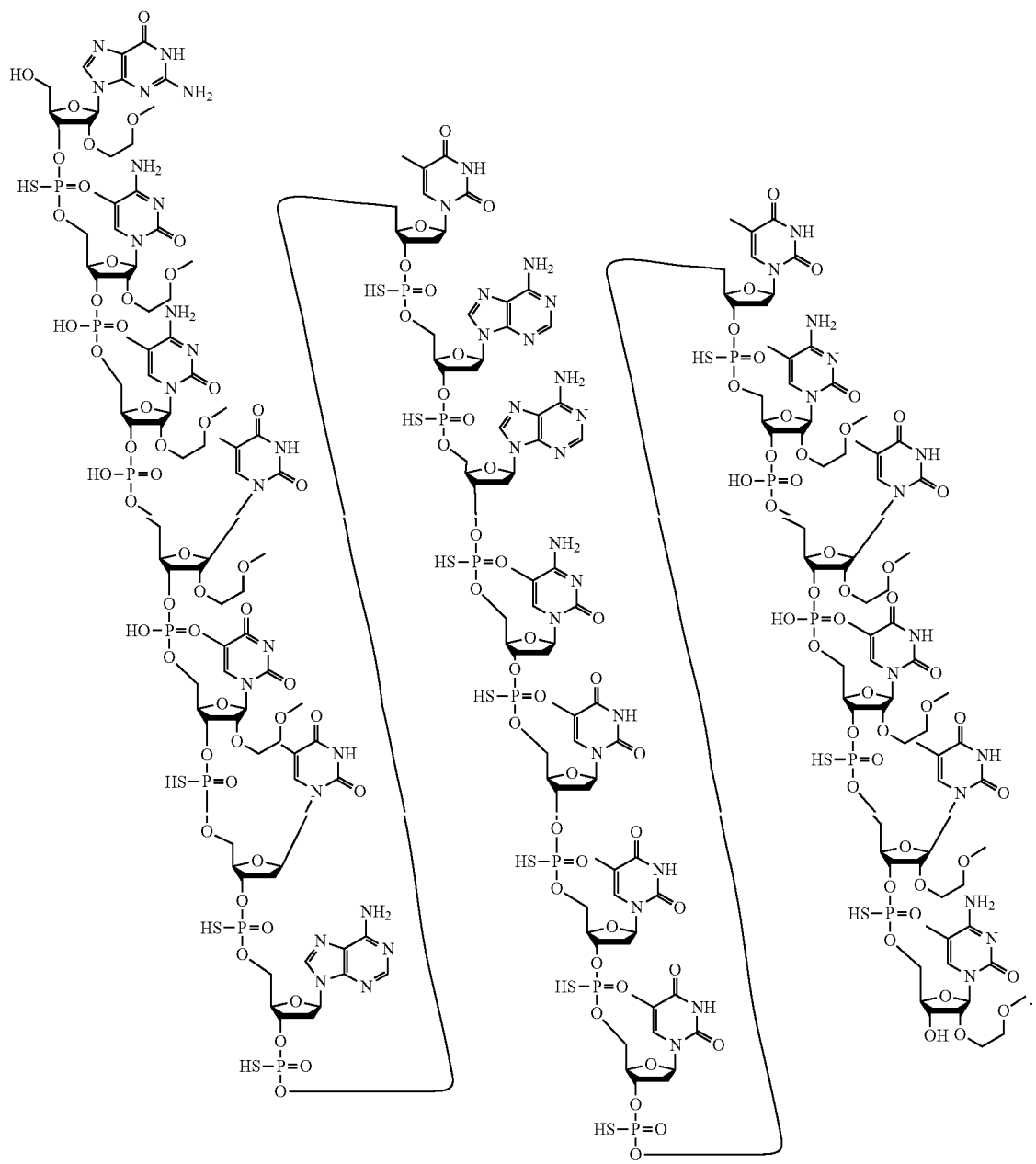

Structure 5. Compound No. 1041927

In certain embodiments, the sodium salt of Compound No. 1041927 is represented by the following chemical structure:

(SEQ ID NO: 3673)

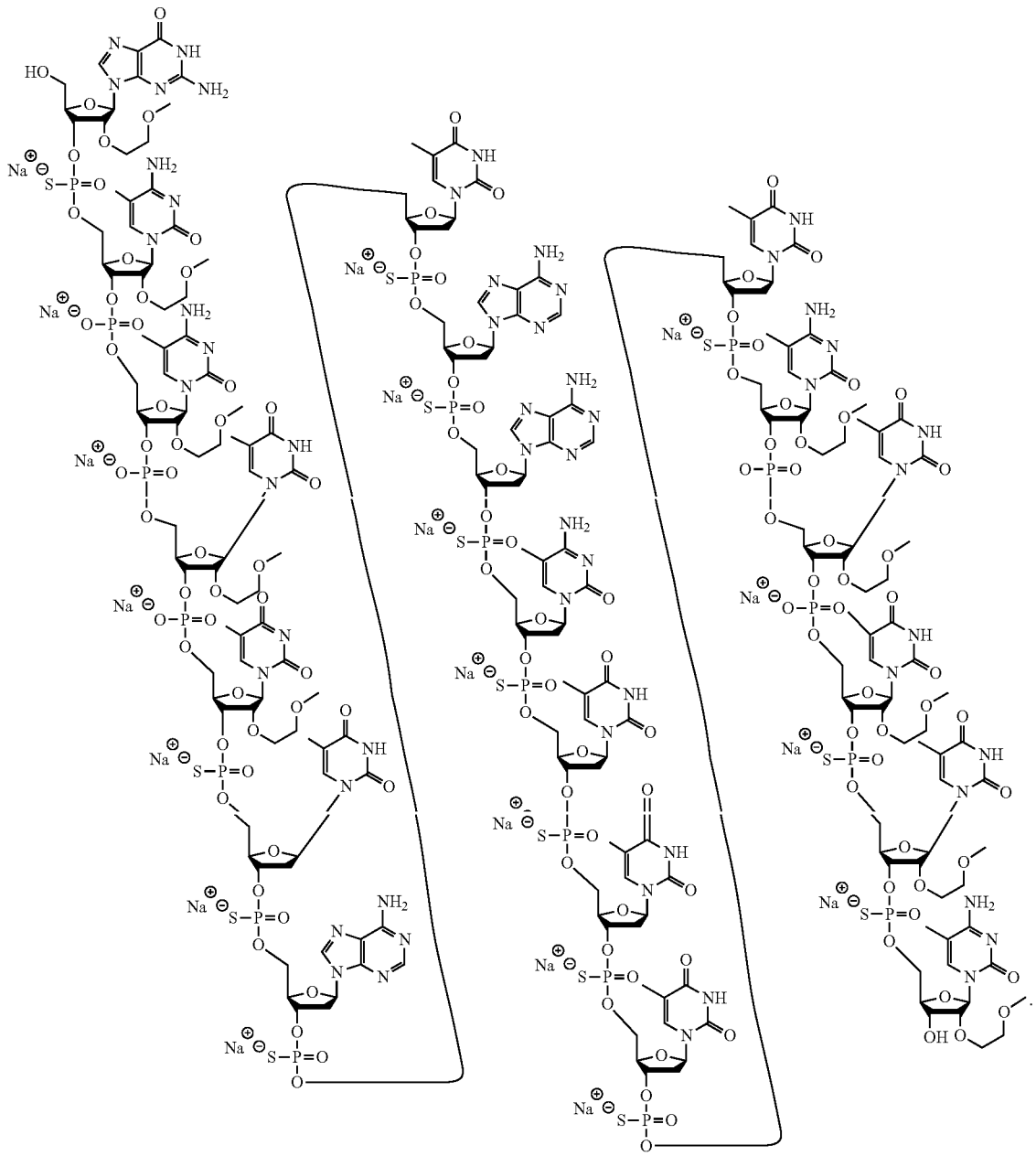

Structure 6. The Sodium Salt of Compound No. 1041927

4. Compound No. 1055001

In certain embodiments, Compound No. 1055001 is characterized as a 5-10-5 MOE gapmer having a sequence of (from 5' to 3') TTCAGTTTAGTTGCAGCCAT (SEQ ID NO: 3190), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1055001 is represented by the following chemical notation (5' to 3'):

(SEQ ID NO: 3674)
Tes Teo $^m$Ceo Aeo Ges Tds Tds Tds Ads Gds Tds Tds Gds $^m$Cds Ads Geo $^m$Ceo $^m$Ces Aes Te, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety, s=a phosphorothioate internucleoside linkage, and
o=a phosphodiester internucleoside linkage.
In certain embodiments, Compound No. 1055001 is represented by the following chemical structure:
(SEQ ID NO: 3674)
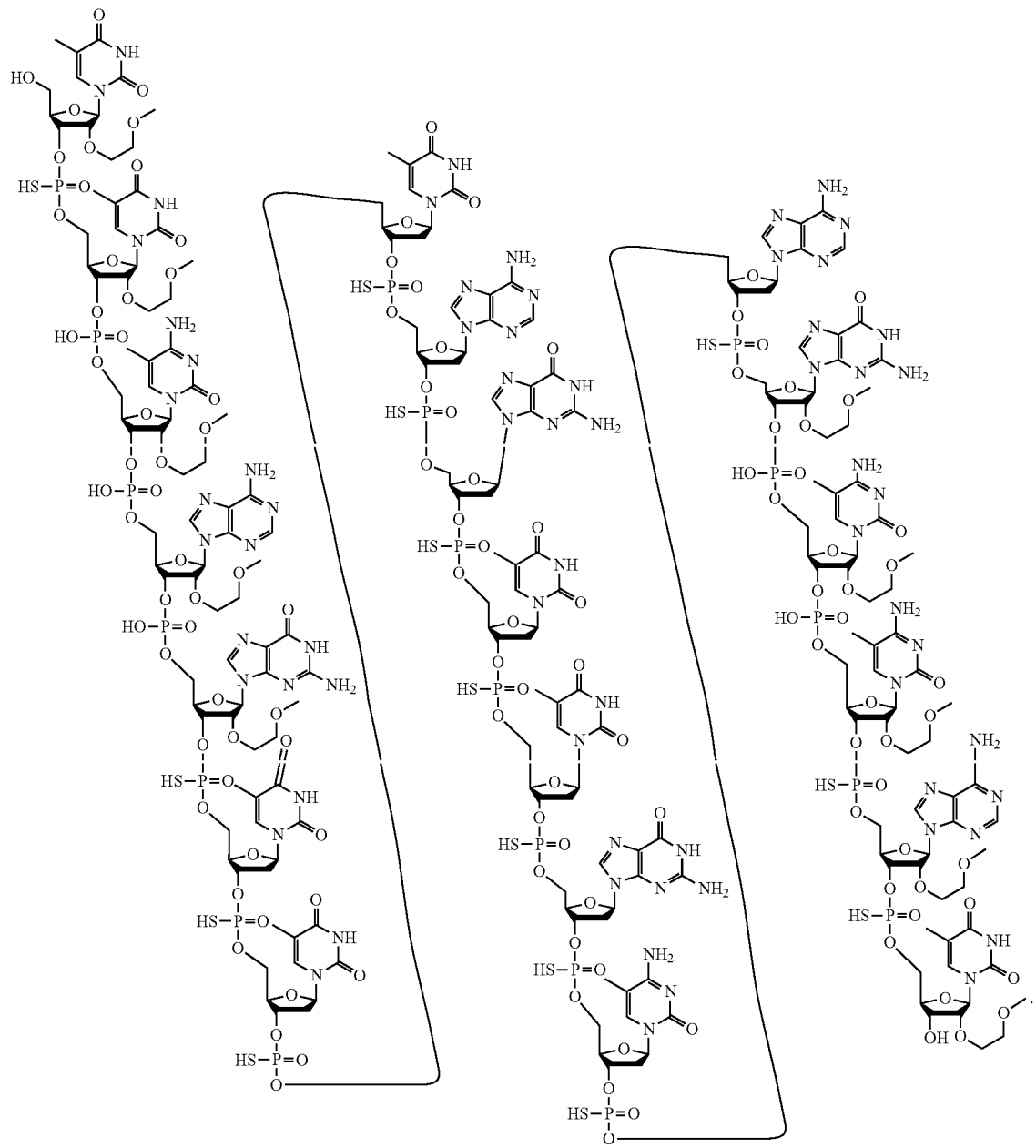
Structure 7. Compound No. 1055001
In certain embodiments, the sodium salt of Compound No. 1055001 is represented by the following chemical structure:

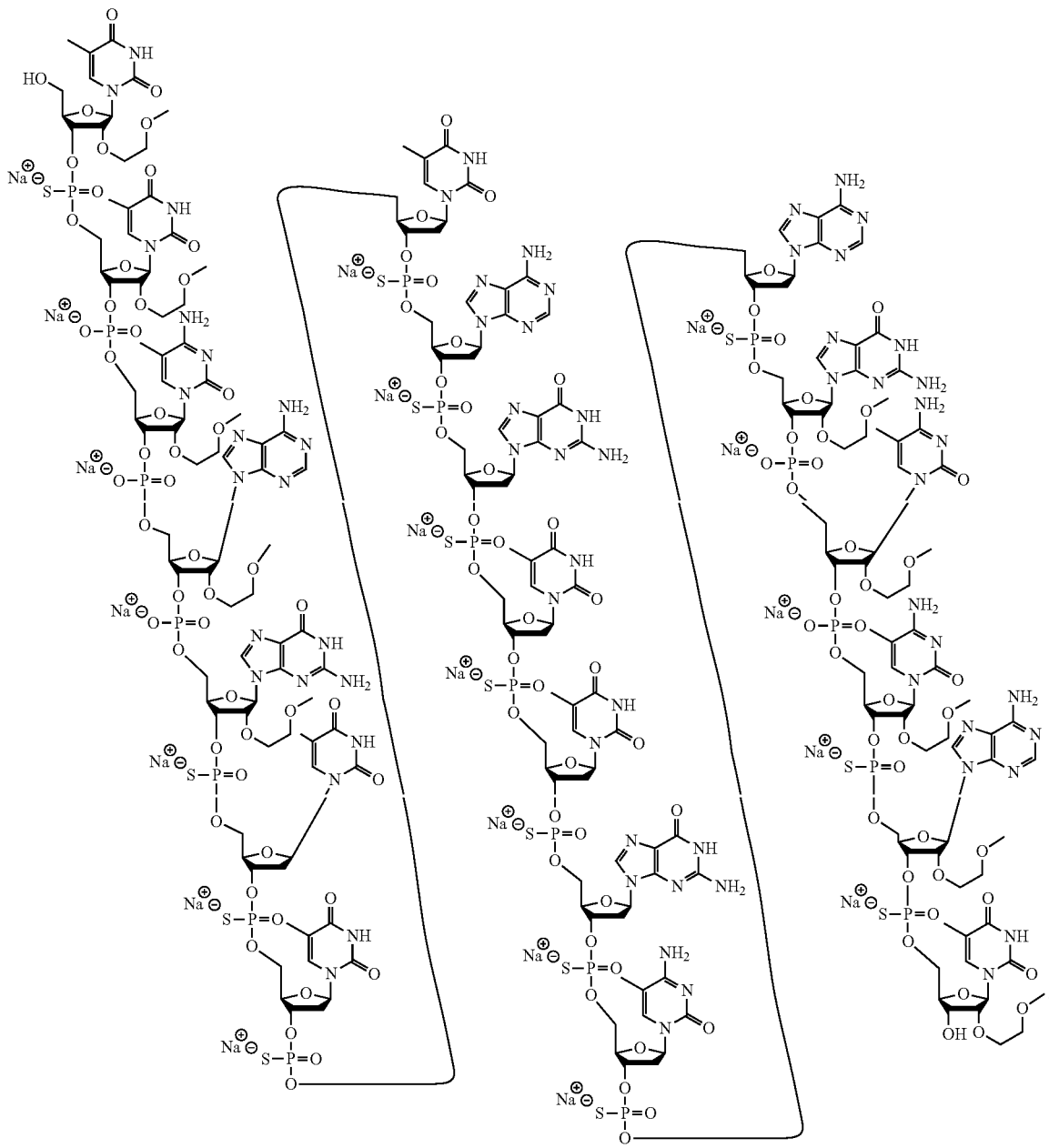

(SEQ ID NO: 3674)

Structure 8. The Sodium Salt of Compound No. 1055001

5. Compound No. 1371311

In certain embodiments, Compound No. 1371311 is characterized as a 5-10-5 MOE gapmer having a sequence of (from 5' to 3') CCCGTATTCCTCTTACCATC (SEQ ID NO: 3590), wherein each of nucleosides 1-5 and 16-20 (from 5' to 3') are 2'-MOE nucleosides and each of nucleosides 6-15 are 2'-β-D-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

In certain embodiments, Compound No. 1371311 is represented by the following chemical notation (5' to 3'):

(SEQ ID NO: 3670)
$^m$Ces $^m$Ceo $^m$Ceo Geo Tes Ads Tds Tds $^m$Cds $^m$Cds Tds $^m$Cds Tds Tds Ads $^m$Ceo $^m$Ceo Aes Tes $^m$Ce, wherein, A=an adenine nucleobase, $^m$C=a 5-methyl cytosine nucleobase, G=a guanine nucleobase, T=a thymine nucleobase, e=a 2'-MOE sugar moiety, d=a 2'-β-D deoxyribosyl sugar moiety, s=a phosphorothioate internucleoside linkage, and o=a phosphodiester internucleoside linkage.

In certain embodiments, Compound No. 1371311 is represented by the following chemical structure:
(SEQ ID NO: 3670)
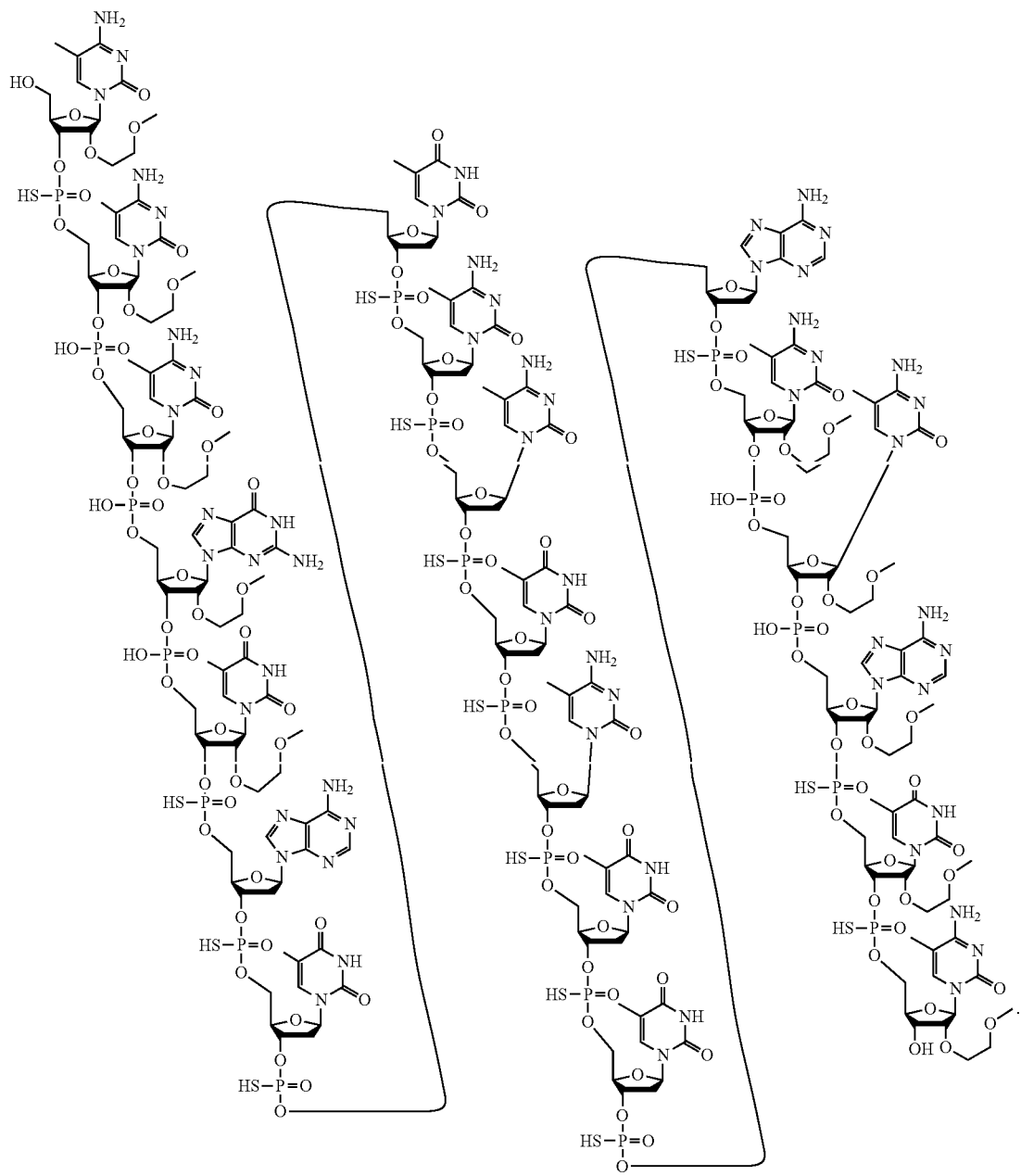
Structure 9. Compound No. 1371311
In certain embodiments, the sodium salt of Compound No. 1371311 is represented by the following chemical structure:

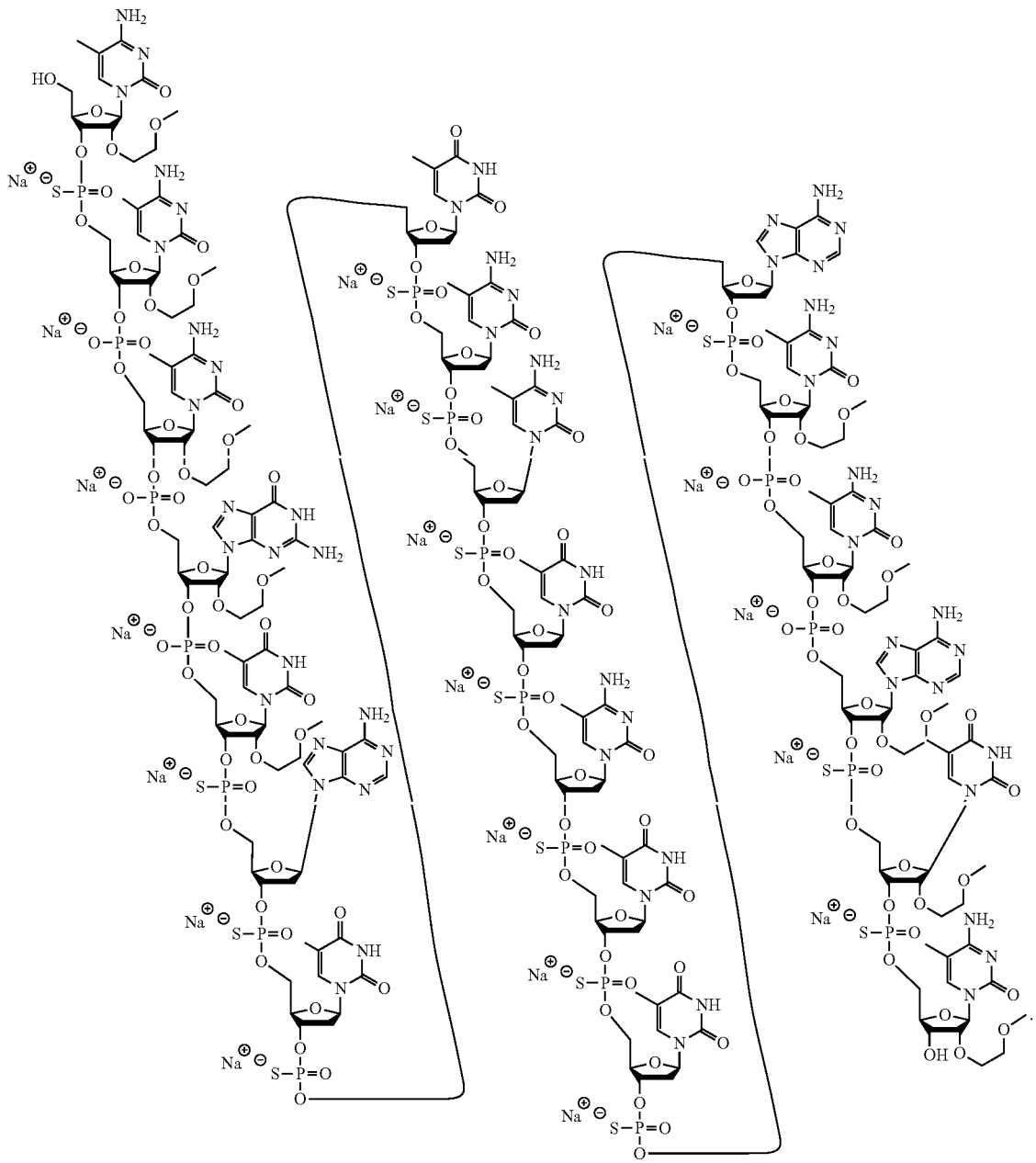

Structure 10. The Sodium Salt of Compound 13711

6. Compound No. 138529

In certain embodiments, Compound No. 1385293 is characterized as ah 5-8-4 MOE gapmer having a sequence of (from 5' to 3') TCAGTTTAGTTGCAGCC (SEQ ID NO: 3638), wherein each of nucleosides 1-5 and 14-17 (from 5' to 3') are 2'-MOE nucleosides and each of nucleosides 6-13 are 2'-β-D-deoxynucleosides, wherein the internucleoside linkages between nucleosides 4 to 5 and 14 to 15 are phosphodiester internucleoside linkages and the internucleoside linkages between nucleosides to 2, 3 to 4, 5 to 6, 6 to 7, 7 to 8, 8 to 9, 9 to 10, 10 to 11, 11 to 12, 12 to 13, 13 to 14, 15 to 16, and 16 to 17 are phosphorothioate internucleoside linkages, and wherein each cytosine is a 5-methyl cytosine.

In certain embodiments, Compound No. 1385293 is represented by the following chemical notation (5' to 3'):

(SEQ ID NO: 3675)
Tes $^m$Ces Aes Geo Tes Tds Tds Ads Gds Tds Tds Gds $^m$Cds Aeo Ges $^m$Ces $^m$Ce, wherein,
A=an adenine nucleobase,
$^m$C=a 5-methyl cytosine nucleobase,
G=a guanine nucleobase,
T=a thymine nucleobase,
e=a 2'-MOE sugar moiety,
d=a 2'-β-D deoxyribosyl sugar moiety,
s=a phosphorothioate internucleoside linkage, and
o=a phosphodiester internucleoside linkage.

In certain embodiments, Compound No. 1385293 is represented by the following chemical structure:
(SEQ ID NO: 3675)
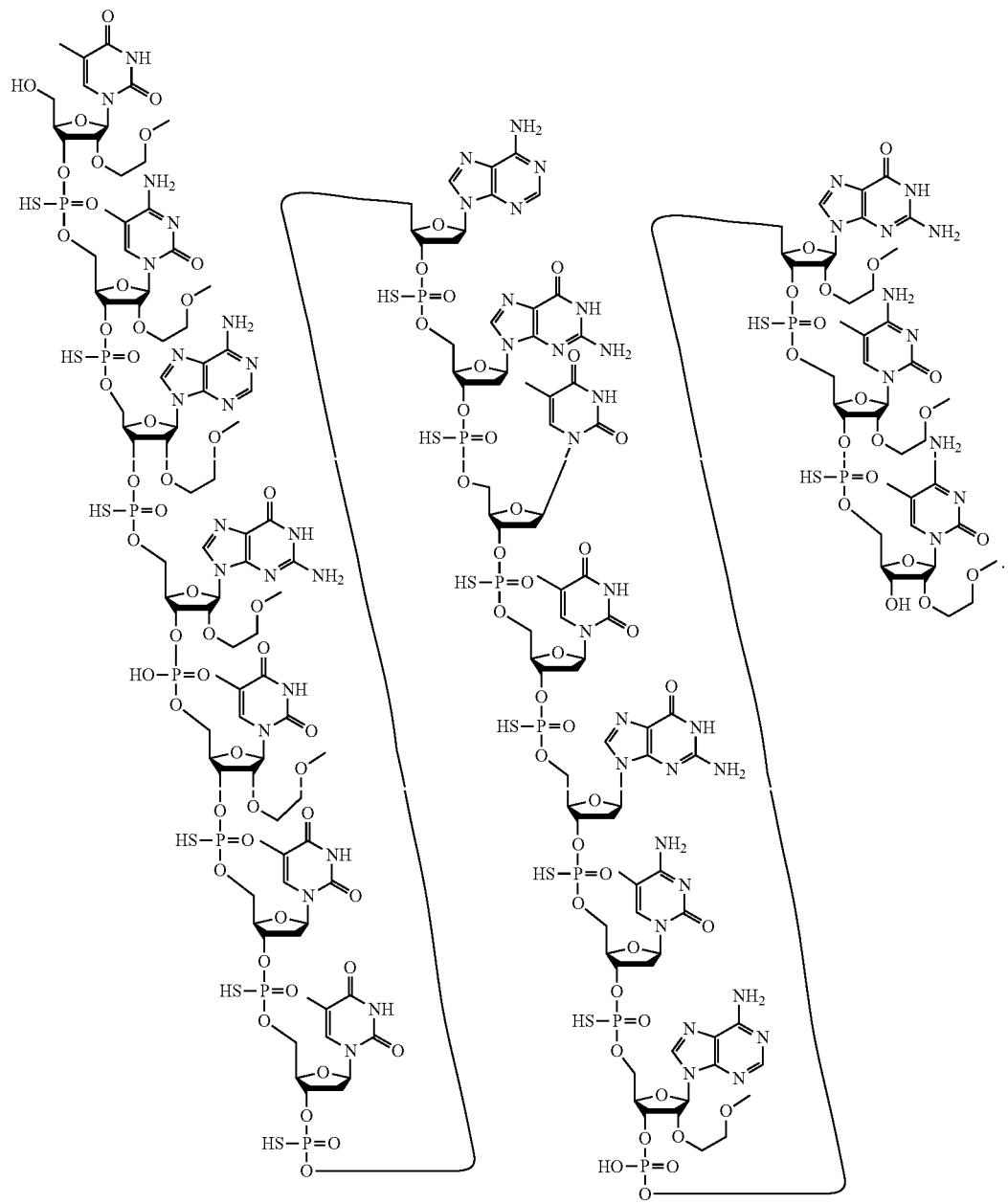
Structure 11. Compound No. 1385293
In certain embodiments, the sodium salt of Compound No. 1385293 is represented by the following chemical structure:

(SEQ ID NO: 3675)

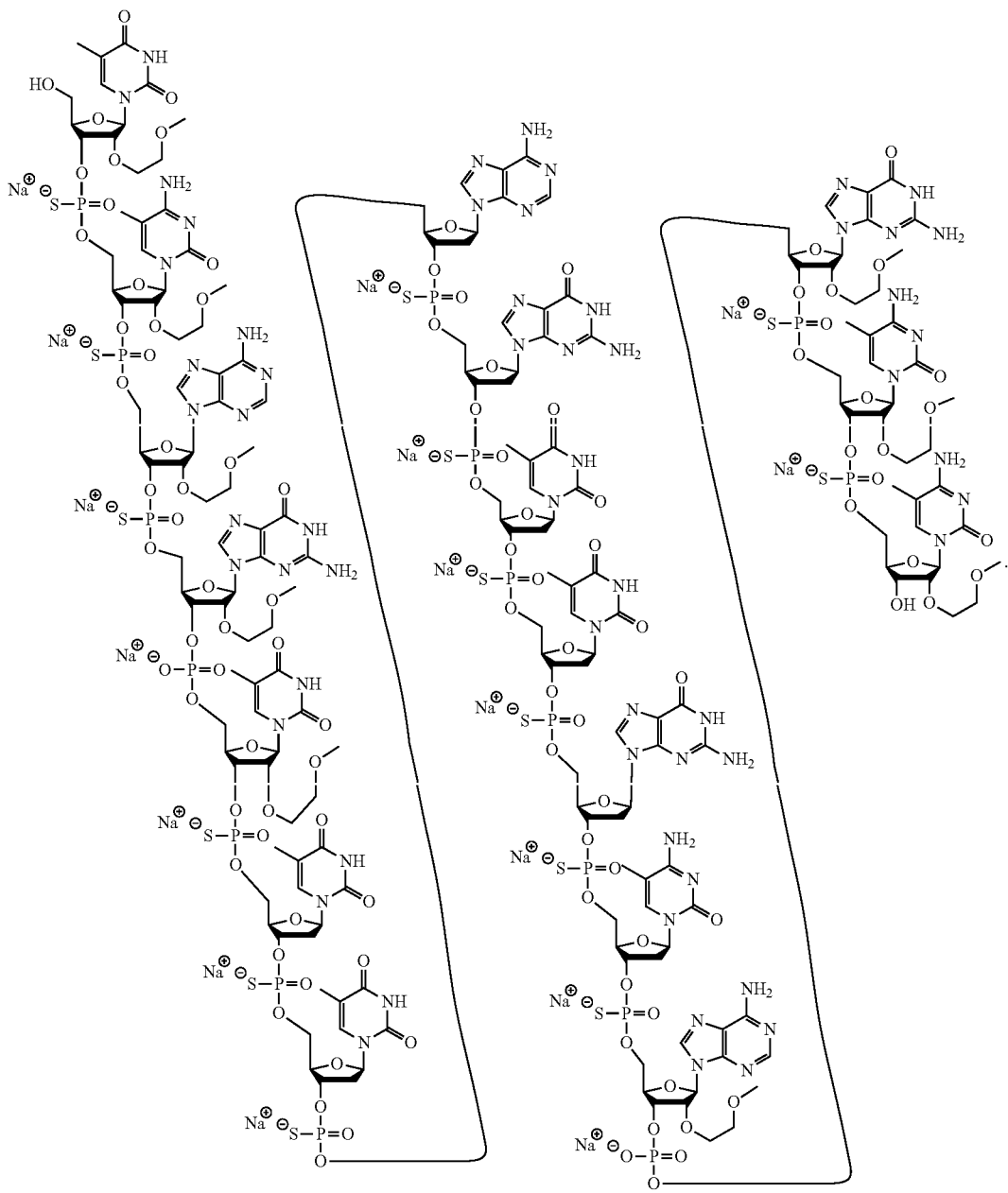

Structure 12. The Sodium Salt of Compound No. 1385293

VIII. Certain Hotspot Regions

In certain embodiments, nucleobases in the ranges specified below comprise a hotspot region of ATXN1 nucleic acid. In certain embodiments, modified oligonucleotides that are complementary within a hotspot region of ATXN1 nucleic acid achieve an average of more than 75% reduction of ATXN1 RNA in vitro in the standard cell assay. In certain embodiments, modified oligonucleotides that are complementary within a hotspot region of ATXN1 nucleic acid achieve an average of 24% or greater reduction of ATXN1 RNA in vivo in the standard in vivo assay. In certain embodiments, modified oligonucleotides that are complementary within a hotspot region of ATXN1 nucleic acid achieve an average of 45% or greater reduction of ATXN1 RNA in vivo in the standard in vivo assay.

1. Nucleobases 5472-5552 of SEQ ID NO: 1 or 459725-459805 of SEQ ID NO: 2

In certain embodiments, nucleobases 5472-5552 of SEQ TD NO: 1 or 459725-459805 of SEQ ID NO: 2 comprise a hotspot region. In certain embodiments, modified oligonucleotides are complementary within nucleobases 5472-5552 of SEQ TD NO: 1 or 459725-459805 of SEQ TD NO: 2. In certain embodiments, modified oligonucleotides are 20 nucleobases in length. In certain embodiments, modified oligonucleotides are 17 nucleobases in length. In certain embodiments, modified oligonucleotides are gapmers. In certain embodiments, modified oligonucleotides are mixed wing gapmers.

In certain embodiments, the gapmers are 5-10-5 MOE gapmers. In certain embodiments, the gapmers are 6-10-4 MOE gapmers. In certain embodiments, the gapmers are 5-8-4 MOE gapmers or 5-8-4 mixed MOE/cEt gapmers. In certain embodiments, the mixed wing gapmers have the sugar motif in order from 5' to 3': eeeeedddddddkkee; wherein 'd' represents a 2'-β-D-deoxyribosyl sugar moiety, 'k' represents a cEt sugar moiety, and 'e' represents a 2'-MOE sugar moiety. In certain embodiments, the gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3'). In certain embodiments, the gapmers have the sugar motif in order from 5' to 3': eeeeedyddddddddeeeee or eeeeedyddddddkkee; wherein 'd' represents a 2'-β-D-deoxyribosyl sugar moiety, 'k' represents a cEt sugar moiety, 'e' represents a 2'-MOE sugar moiety, and "y" represents a 2'-OMe sugar moiety.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, sssosssssssssssosss, sssosssssssss-soss, or sooooosssssssssssoss wherein each "s" represents a phosphorothioate internucleoside linkage and each "o" represents a phosphodiester internucleoside linkage.

The nucleobase sequences of SEQ ID Nos: 196, 274, 352, 430, 508, 2578, 2655, 2732, 2809, 2886, 2963, 3121, 3122, 3190, 3191, 3192, 3262, 3330, 3331, 3332, 3401, 3402, 3575, 3577, 3620, 3624, 3638-3640, 3653-3655, 3662, 3665, and 3669 are complementary within nucleobases 5472-5552 of SEQ ID NO: 1 or 459725-459805 of SEQ ID NO: 2.

The nucleobase sequence of Compound Nos.: 994446-994450, 1040296-1040301, 1055001-1055011, 1342062, 1342063, 1342067, 1342068, 1365271, 1365272, 1365274, 1365294, 1365299, 1365300, 1371818, 1371821, 1371827, 1371829, 1371837, 1371843, 1371866, 1371869, 1371871, 1371876, 1385293, 1394156-1394160, 1394162, 1394164, 1394166-1394168, 1394533, 1394544, 1394546, 1394549, and 1394553 are complementary within nucleobases 5472-5552 of SEQ ID NO: 1 or 459725-459805 of SEQ ID NO: 2.

In certain embodiments, modified oligonucleotides complementary within nucleobases 5472-5552 of SEQ ID NO: 1 or 459725-459805 of SEQ ID NO: 2 achieve at least 58% reduction of ATXN1 RNA in vitro in the standard cell assay. In certain embodiments, modified oligonucleotides complementary within nucleobases 5472-5552 of SEQ ID NO: 1 or 459725-459805 of SEQ ID NO: 2 achieve an average of 90% reduction of ATXN1 RNA in vitro in the standard cell assay. In certain embodiments, modified oligonucleotides complementary within nucleobases 5472-5552 of SEQ ID NO: 1 or 459725-459805 of SEQ ID NO: 2 achieve an average of 52% reduction of ATXN1 RNA in vivo in the standard in vivo assay.

2. Nucleobases 5906-6005 of SEQ ID NO: 1 or 460159-460258 of SEQ ID NO: 2

In certain embodiments, nucleobases 5906-6005 of SEQ ID NO: 1 or 460159-460258 of SEQ ID NO: 2 comprise a hotspot region. In certain embodiments, modified oligonucleotides are complementary to nucleobases 5906-6005 of SEQ ID NO: 1 or 460159-460258 of SEQ ID NO: 2. In certain embodiments, modified oligonucleotides are 20 nucleobases in length. In certain embodiments, modified oligonucleotides are 17 nucleobases in length. In certain embodiments, modified oligonucleotides are mixed wing gapmers.

In certain embodiments, the gapmers are 5-10-5 MOE gapmers. In certain embodiments, the gapmers are 6-10-4 MOE gapmers. In certain embodiments, the gapmers are 5-8-4 MOE gapmers or 5-8-4 mixed MOE/cEt gapmers. In certain embodiments, the mixed wing gapmers have the sugar motif in order from 5' to 3': eeeeedddddddkkee; wherein 'd' represents a 2'-β-D-deoxyribosyl sugar moiety, 'k' represents a cEt sugar moiety, and 'e' represents a 2'-MOE sugar moiety.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, sssosssssssssssosss, sssosssssssss-soss, or sooooosssssssssssoss wherein each "s" represents a phosphorothioate internucleoside linkage and each "o" represents a phosphodiester internucleoside linkage.

The nucleobase sequences of SEQ ID Nos: 42, 120, 198, 276, 509, 587, 2502, 2579, 2656, 2733, 2810, 2887, 2964, 3585, 3588-3590, 3615, 3618, 3622, 3657, 3660, 3661, 3663, 3664, and 3666-3668 are complementary within nucleobases 5906-6005 of SEQ ID NO: 1 or 460159-460258 of SEQ ID NO: 2.

The nucleobase sequence of Compound Nos.: 994458-994463, 1040327-1040333, 1367569, 1367580-1367581, 1367589-1367591, 1371311, 1371820, 1371823, 1371825, 1371842, 1371865, 1371868, 1371870, 1371873, 1371875, 1371877, 1394161, 1394163, 1394165, 1394524, 1394538, 1394541, 1394543, 1394545, 1394548, and 1394550-1394552 are complementary within nucleobases 5906-6005 of SEQ ID NO: 1 or 460159-460258 of SEQ ID NO: 2.

In certain embodiments, modified oligonucleotides complementary within 5906-6005 of SEQ ID NO: 1 or 460159-460258 of SEQ ID NO: 2 achieve at least 26% reduction of ATXN1 RNA in vitro in the standard cell assay. In certain embodiments, modified oligonucleotides complementary within nucleobases 5906-6005 of SEQ ID NO: 1 or 460159-460258 of SEQ ID NO: 2 achieve an average of 78% reduction of ATXN1 RNA in vitro in the standard cell assay. In certain embodiments, modified oligonucleotides complementary within nucleobases 5906-6005 of SEQ ID NO: 1 or 460159-460258 of SEQ ID NO: 2 achieve an average of 51% reduction of ATXN1 RNA in vivo in the standard in vivo assay.

3. Nucleobases 7868-7911 of SEQ ID NO: 1 or 462121-462164 of SEQ ID NO: 2

In certain embodiments, nucleobases 7868-7911 of SEQ ID NO: 1 or 462121-462164 of SEQ ID NO: 2 comprise a hotspot region. In certain embodiments, modified oligonucleotides are complementary to nucleobases 7868-7911 of SEQ ID NO: 1 or 462121-462164 of SEQ ID NO: 2. In certain embodiments, modified oligonucleotides are 20 nucleobases in length. In certain embodiments, modified oligonucleotides are gapmers.

In certain embodiments, the gapmers are 5-10-5 MOE gapmers. In certain embodiments, the gapmers are 6-10-4 MOE gapmers.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, sssosssssssssssosss, or sooooosssssssssssoss wherein each "s" represents a phosphorothioate internucleoside linkage and each "o" represents a phosphodiester internucleoside linkage.

The nucleobase sequences of SEQ ID Nos: 48, 126, 2044, and 2121 are complementary within nucleobases 7868-7911 of SEQ ID NO: 1 or 462121-462164 of SEQ ID NO: 2.

The nucleobase sequence of Compound Nos.: 994508, 994509, 1040499, 1040450, 1394513, and 1394529 are complementary within nucleobases 7868-7911 of SEQ ID NO: 1 or 462121-462164 of SEQ ID NO: 2.

In certain embodiments, modified oligonucleotides complementary within 7868-7911 of SEQ ID NO: 1 or 462121-462145 of SEQ ID NO: 2 achieve at least 61% reduction of ATXN1 RNA in vitro in the standard cell assay. In certain embodiments, modified oligonucleotides complementary within nucleobases 7868-7911 of SEQ ID NO: 1 or 462121-462145 of SEQ ID NO: 2 an average of 79% reduction of ATXN1 RNA in vitro in the standard cell assay. In certain embodiments, modified oligonucleotides complementary within nucleobases 7868-7911 of SEQ ID NO: 1 or 462121-462164 of SEQ ID NO: 2 achieve an average of 53% reduction of ATXN1 RNA in vivo in the standard in vivo assay.

4. Nucleobases 8481-8514 of SEQ ID NO: 1 or 462734-462767 of SEQ ID NO: 2

In certain embodiments, nucleobases 8481-8514 of SEQ ID NO: 1 or 462734-462767 of SEQ ID NO: 2 comprise a hotspot region. In certain embodiments, modified oligonucleotides are complementary to nucleobases 8481-8514 of SEQ ID NO: 1 or 462734-462767 of SEQ ID NO: 2. In certain embodiments, modified oligonucleotides are 20 nucleobases in length. In certain embodiments, modified oligonucleotides are gapmers.

In certain embodiments, the gapmers are 5-10-5 MOE gapmers. In certain embodiments, the gapmers are 6-10-4 MOE gapmers.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, sssosssssssssssosss, or sooooosssssssssssoss wherein each "s" represents a phosphorothioate internucleoside linkage and each "o" represents a phosphodiester internucleoside linkage.

The nucleobase sequences of SEQ ID Nos: 128, 206, 284, 1045, 1122, 1199, and 1276 are complementary within nucleobases 8481-8514 of SEQ ID NO: 1 or 462734-462767 of SEQ ID NO: 2.

The nucleobase sequence of Compound Nos.: 994525-994527, 1040500-1040503, 1394514, and 1394525 are complementary within nucleobases 8481-8514 of SEQ ID NO: 1 or 462734-462767 of SEQ ID NO: 2.

In certain embodiments, modified oligonucleotides complementary within 8481-8514 of SEQ ID NO: 1 or 462734-462767 of SEQ ID NO: 2 achieve at least 54% reduction of ATXN1 RNA in vitro in the standard cell assay. In certain embodiments, modified oligonucleotides complementary within nucleobases 8481-8514 of SEQ ID NO: 1 or 462734-462767 of SEQ ID NO: 2 achieve an average of 79% reduction of ATXN1 RNA in vitro in the standard cell assay. In certain embodiments, modified oligonucleotides complementary within nucleobases 8481-8514 of SEQ ID NO: 1 or 462734-462767 of SEQ ID NO: 2 achieve an average of 48% reduction of ATXN1 RNA in vivo in the standard in vivo assay.

5. Nucleobases 446679-446706 of SEQ ID NO: 2

In certain embodiments, nucleobases 446679-446706 of SEQ ID NO: 2 comprise a hotspot region. In certain embodiments, modified oligonucleotides are complementary to nucleobases 446679-446706 of SEQ ID NO: 2. In certain embodiments, modified oligonucleotides are 20 nucleobases in length. In certain embodiments, modified oligonucleotides are gapmers.

In certain embodiments, the gapmers are 5-10-5 MOE gapmers. In certain embodiments, the gapmers are 6-10-4 MOE gapmers.

In certain embodiments, 446679-446706 of SEQ ID NO: 2 comprise a hotspot region. In certain embodiments, modified oligonucleotides are complementary within 446679-446706 of SEQ ID NO: 2. In certain embodiments, modified oligonucleotides are 20 nucleobases in length. In certain embodiments, modified oligonucleotides are 17 nucleobases in length. In certain embodiments, modified oligonucleotides are gapmers. In certain embodiments, the gapmers are MOE gapmers. In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, sssosssssssssssosss, or sooooosssssssssssoss wherein each "s" represents a phosphorothioate internucleoside linkage and each "o" represents a phosphodiester internucleoside linkage.

The nucleobase sequences of SEQ ID Nos: 2475, 2552, 2629, 2706, 2783, 3627-3630, and 3644 are complementary within nucleobases 446679-446706 of SEQ ID NO: 2.

The nucleobase sequence of Compound Nos.: 1041926-1041930, 1364282, 1365258-1365261, 1365282-1365284, 1365287, and 1394522 are complementary within nucleobases 446679-446706 of SEQ ID NO: 2.

In certain embodiments, modified oligonucleotides complementary within nucleobases 446679-446706 of SEQ ID NO: 2 achieve at least 67% reduction of ATXN1 RNA in vitro in the standard cell assay. In certain embodiments, modified oligonucleotides complementary within nucleobases 446679-446706 of SEQ ID NO: 2. achieve an average of 81% reduction of ATXN1 RNA in vitro in the standard cell assay.

6. Additional Hotspot Regions

In certain embodiments, the ranges described in the Table below comprise hotspot regions. Each hotspot region begins with the nucleobase of SEQ ID NO:1 identified in the "Start Site SEQ ID NO: 1" column and ends with the nucleobase of SEQ ID NO: 1 identified in the "Stop Site SEQ ID NO: 1" column. In certain embodiments, modified oligonucleotides are complementary within any of the hotspot regions 1-53, as defined in the table below. In certain embodiments, modified oligonucleotides are 17 nucleobases in length. In certain embodiments, modified oligonucleotides are 20 nucleobases in length.

In certain embodiments, the gapmers are 5-10-5 MOE gapmers. In certain embodiments, the gapmers are 6-10-4 MOE gapmers. In certain embodiments, the gapmers are 5-8-4 MOE gapmers or 5-8-4 mixed MOE/cEt gapmers. In certain embodiments, the mixed wing gapmers have the sugar motif in order from 5' to 3': eeeeeddddddddkkee; wherein 'd' represents a 2'-β-D-deoxyribosyl sugar moiety, 'k' represents a cEt sugar moiety, and 'e' represents a 2'-MOE sugar moiety. In certain embodiments, gapmers comprise a 2'-substituted nucleoside in the gap. In certain embodiments, the 2'-substituted nucleoside comprises a 2'-OMe sugar moiety. In certain embodiments, the 2'-substituted nucleoside is at position 2 of the gap (5' to 3'). In certain embodiments, the gapmers have the sugar motif in order from 5' to 3': eeeeedydddddddeeeee or eeeeedyddddddkkee; wherein 'd' represents a 2'-β-D-deoxyribosyl sugar moiety, 'k' represents a cEt sugar moiety, 'e' represents a 2'-MOE sugar moiety, and "y" represents a 2'-OMe sugar moiety.

In certain embodiments, the internucleoside linkages of the modified oligonucleotides are phosphorothioate internucleoside linkages and phosphodiester internucleoside linkages. In certain embodiments, the phosphodiester ("o") and phosphorothioate ("s") internucleoside linkages are arranged in order from 5' to 3': In certain embodiments, modified nucleotides have an internucleoside linkage motif of sooosssssssssssooss, sssosssssssssssosss, sssosssssssssoss, or sooooossssssssssoss wherein each "s" represents a phosphorothioate internucleoside linkage and each "o" represents a phosphodiester internucleoside linkage.

The nucleobase sequence of compounds listed in the "Compound No. in range" column in the table below are complementary to SEQ ID NO: 2 within the specified hotspot region. The nucleobase sequence of the oligonucleotides listed in the "SEQ ID NO: in range" column in the table below are complementary to the target sequence, SEQ ID NO: 2, within the specified hotspot region.

In certain embodiments, modified oligonucleotides complementary to nucleobases within the hotspot region achieve at least "Min. % Red. in vitro" (minimum % reduction, relative to untreated control cells) of ATXN1 RNA in vitro in the standard cell assay, as indicated in the table below. In certain embodiments, modified oligonucleotides complementary to nucleobases within the hotspot region achieve an average of "Avg. % Red. in vitro" (average % reduction, relative to untreated control cells) of ATXN1 RNA in vitro in the standard cell assay, as indicated in the table below. In certain embodiments, modified oligonucleotides complementary to nucleobases within the hotspot region achieve a maximum of "Max. % Red. in vitro" (maximum % reduction, relative to untreated control cells) of ATXN1 RNA in vitro in the standard cell assay, as indicated in the table below. In certain embodiments, modified oligonucleotides complementary to nucleobases within the hotspot region achieve an average of "Avg. % Red. in vivo" (average % reduction, relative to PBS-treated animals) of ATXN1 RNA in vivo in the standard in vivo assay in cortical tissue, as indicated in the table below. Note that due to the transgenic mouse model used, only compounds targeting nucleosides 435531-464889 of SEQ ID NO: 2 were tested in vivo; "n.d." indicates that no in vivo data are available for compounds within that range. In other cases, average reduction in vivo includes a subset of the compounds in any given hotspot, as not all compounds were tested in vivo.

TABLE 1

ATXN1 Hotspots

| Hotspot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
|---|---|---|---|---|---|---|---|---|---|---|
| 1 | 5477 | 5552 | 459730 | 459805 | 58 | 96 | 90 | 54 | 994446-994450, 1040296-1040301, 1055001-1055011, 1342062, 1342067, 1365271, 1365272, 1365274, 1365294, 1365299-1365300, 1371818, 1371827, 1371829, 1371837, 1371843, 1371871, 1371876, 1385293, 1394156-1394160, 1394162, 1394164, 1394166-1394168, 1394533, 1394544, 1394546, 1394549, 1394553 | 196, 274, 352, 430, 508, 2578, 2655, 2732, 2809, 2886, 2963, 3121, 3122, 3190-3192, 3262, 3330-3332, 3401, 3402, 3575, 3577, 3620, 3624, 3638-3640, 3653-3655, 3662, 3665, 3669 |
| 2 | 5906 | 6005 | 460159 | 460258 | 26 | 97 | 78 | 51 | 994458-994463, 1040327-1040333, 1367569, 1367580-1367581, 1367589-1367591, 1371311, 1371820, 1371823, 1371825, 1371842, 1371865, 1371868, 1371870, 1371873, 1371875, 1371877, 1394161, 1394163, 1394165, 1394524, 1394538, 1394541, 1394543, 1394545, | 42, 120, 198, 276, 509, 587, 2502, 2579, 2656, 2733, 2810, 2887, 2964, 3585, 3588-3590, 3615, 3618, 3622, 3657, 3660, 3661, 3663, 3664, 3666-3668 |

TABLE 1-continued

ATXN1 Hotspots

| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
|---|---|---|---|---|---|---|---|---|---|---|
| 3 | 7868 | 7911 | 462121 | 462145 | 61 | 94 | 79 | 53 | 1394548, 1394550-1394552 994508, 994509, 1040499, 1040450, 1394513, 1394529 | 48, 126, 2044, 2121 |
| 4 | 8481 | 8514 | 462734 | 462767 | 54 | 89 | 79 | 48 | 994525-994527, 1040500-1040503, 1394514, 1394525 | 128, 206, 284, 1045, 1122, 1199, 1276 |
| 5 | N/A | N/A | 446679 | 446706 | 67 | 89 | 81 | 24 | 1041926-1041930, 1364282, 1365258-1365261, 1365282-1365284, 1365287, 1394522 | 2475, 2552, 2629, 2706, 2783, 3627-3630, 3644 |
| 6 | 99 | 140 | 2609 | 2650 | 43 | 90 | 76 | n.d. | 994310-994313, 1054946-1054957 | 179, 257, 335, 413, 3111-3113, 3183, 3253-3254, 3321-3322, 3394-3395, 3464-3465 |
| 7 | 195 | 227 | 9911 | 9943 | 64 | 92 | 78 | n.d. | 994597-994601, 1055055-1055061 | 137, 215, 293, 371, 449, 3131-3132, 3201, 3341-3342, 3410, 3478 |
| 8 | 243 | 275 | 10654 | 10686 | 75 | 93 | 85 | n.d. | 994314, 1054962-1054971 | 491, 3114, 3184-3185, 3255-3256, 3323-3324, 3396, 3466-3467 |
| 9 | 413 | 454 | 106155 | 106196 | 68 | 95 | 86 | n.d. | 994318-994324 | 25, 180, 258, 336, 414, 492, 570 |
| 10 | 500 | 589 | 178110 | 178199 | 60 | 98 | 88 | n.d. | 994325-994328, 1054972-1054984 | 103, 181, 259, 337, 3115-3117, 3186-3187, 3257-3258, 3325-3326, 3397-3398, 3468-3469 |
| 11 | 587 | 619 | N/A | N/A | 80 | 99 | 94 | n.d. | 994329, 1054990-1054999 | 415, 3119, 3188-3189, 3260-3261, 3328-3329, 3400, 3471-3472 |
| 12 | 3984 | 4031 | 458237 | 458284 | 77 | 95 | 83 | 24 | 994408-994409, 1040170-1040173 | 347, 425, 2728, 2805, 2882, 2959, 3036 |
| 13 | 4434 | 4457 | 458687 | 458710 | 88* | 88* | 88* | 49 | 994419, 1342032, 1364280, 1365267, 1365268, 1365270, 1365290-1365292, 1365298, 1371322, 1371325, 1371809, 1371824, 1371851, 1371854, 1371872, 1385295, 1394153-1394155, 1394534, 1394537, 1394539, 1394540, 1394547 | 582, 3563, 3593, 3605, 3621, 3635-3637, 3648-3649, 3652, 3656, 3658-3659 |
| 14 | 4497 | 4553 | 458750 | 458806 | 48 | 91 | 78 | 25 | 1040205-1040211 | 651, 728, 805, 882, 959, 2960, 3037 |
| 15 | 4586 | 4640 | 458839 | 458893 | 63 | 99 | 87 | 50 | 994420-994422, 1040212-1040215 | 37, 115, 193, 1036, 1113, 1190, 1267 |

TABLE 1-continued

| ATXN1 Hotspots | | | | | | | | | | |
|---|---|---|---|---|---|---|---|---|---|---|
| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
| 16 | 4725 | 4786 | 458978 | 459039 | 24 | 98 | 77 | 33 | 994429-994430, 1040222-1040239, 1342061, 1342064, 1342069, 1342071, 1342074-1342076, 1364283, 1365262-1356265, 1365285-1365286, 1365288-1365289, 1371808, 1371810, 1371813, 1371815-1371816, 1371819, 1371822, 1371844-1371845, 1371848, 1371853, 1385294, 1394507, 1394511, 1394518, 1394523, 1394527 | 116, 194, 652, 1806, 1883, 1960, 2037, 2114, 2191, 2268, 2345, 2422, 2499, 2576, 2653, 2730, 2807, 2884, 2961, 3038, 3558, 3560-3562, 3574, 3576, 3578, 3592, 3594, 3597, 3604, 3631-3635, 3645, 3646-3647 |
| 17 | 6015 | 6099 | 460268 | 460352 | 58 | 94 | 78 | 34 | 994464-994469, 1040334-1040344, 1055012-1055023, 1342039, 1342041, 1342044, 1342046, 1342048 | 43, 121, 354, 1432, 510, 588, 655, 732, 809, 886, 963, 1040, 1117, 1194, 1271, 1348, 3041, 3123-3125, 3193-3194, 3263-3264, 3333-3334, 3403, 3473-3474, 3541, 3543, 3545, 3565, 3569 |
| 18 | 6919 | 6960 | 461172 | 461213 | 90 | 96 | 93 | 50 | 994484, 1040382-1040384 | 45, 1811, 1888, 1965 |
| 19 | 7076 | 7114 | 461329 | 461367 | 76 | 98 | 89 | 58 | 994490-994496, 1040393-1040395, 1394166-1394167, 1394516, 1394530 | 46, 124, 202, 280, 358, 513, 591, 2658, 2735, 2812 |
| 20 | 7696 | 7741 | 461949 | 461994 | 74 | 94 | 87 | 29 | 994506, 1040435-1040438 | 515, 966, 1043, 1120, 1197 |
| 21 | 8194 | 8257 | 462447 | 462510 | 58 | 97 | 82 | 37 | 994516-994521, 1040472-1040482, 1394512, 1394517, 1394528, 1394531 | 49, 127, 205, 283, 361, 439, 1352, 1429, 1506, 1583, 1660, 1737, 1814, 1891, 1968, 2045, 2122 |
| 22 | 9181 | 9214 | 463434 | 463467 | 68 | 97 | 82 | 51 | 994549-994551, 1040566-1040567 | 131, 209, 287, 1201, 1278 |
| 23 | 9472 | 9513 | 463725 | 463766 | 79 | 91 | 84 | 25 | 994559-994561, 1055024-1055036 | 288, 366, 444, 3126-3127, 3195-3197, 3265-3266, 3335-3336, 3404-3405, 3475-3476 |
| 24 | 9667 | 9730 | 463920 | 463983 | 75 | 94 | 86 | 35 | 994562-994564, 1040612-1040613 | 55, 522, 600, 2280, 2357 |
| 25 | 10095 | 10121 | 464348 | 464374 | 66 | 95 | 84 | 13 | 994571, 1055043-1055048 | 601, 3129, 3199, 3268, 3339, 3407, 3408 |
| 26 | 10133 | 10158 | 464386 | 464411 | 84 | 92 | 88 | n.d. | 994572-994574, 1040633 | 56, 134, 212, 1434 |
| 27 | 10237 | 10277 | 464490 | 464530 | 72 | 90 | 82 | n.d. | 994579-994580, 1040653-1040658 | 57, 602, 665, 742, 819, 896, 2974, 3051 |

TABLE 1-continued

| | ATXN1 Hotspots | | | | | | | | | |
|---|---|---|---|---|---|---|---|---|---|---|
| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
| 28 | 10311 | 10353 | 464564 | 464606 | 80 | 95 | 89 | n.d. | 994581-994583 1040663-1040666 | 135, 213, 291, 1281, 1358, 1435, 1512 |
| 29 | N/A | N/A | 439072 | 439126 | 69 | 99 | 87 | 47 | 994809-994811, 1041407-1041414, 1364281, 1365254-1365255, 1365278, 1365281, 1394526 | 475, 553, 631, 1920, 1997, 2074, 2151, 2228, 2305, 2382, 2459, 3625-3626, 3642-3643 |
| 30 | N/A | N/A | 17722 | 17748 | 72 | 99 | 87 | n.d. | 994605, 1055065-1055071 | 138, 3134, 3202-3203, 3270, 3343, 3412, 3480 |
| 31 | N/A | N/A | 85512 | 85545 | 64 | 92 | 76 | n.d. | 994630, 1055084-1055094 | 219, 3137, 3206-3207, 3273-3274, 3346-3347, 3415-3416, 3483-3484 |
| 32 | N/A | N/A | 179779 | 179809 | 43 | 96 | 81 | n.d. | 994690, 1055106-1055113 | 538, 3140, 3210, 3276-3277, 3350, 3419-3420, 3487 |
| 33 | N/A | N/A | 184181 | 184213 | 85 | 99 | 94 | n.d. | 994693, 1055123-1055132 | 149, 3143, 3212-3213, 3280, 3352-3353, 3422-3423, 3490-3491 |
| 34 | N/A | N/A | 203033 | 203066 | 48 | 94 | 76 | n.d. | 994700, 1055137-1055147 | 72, 3144-3145, 3214-3215, 3282-3283, 3355-3356, 3425, 3493-3494 |
| 35 | N/A | N/A | 203889 | 203914 | 81 | 98 | 92 | n.d. | 994701, 1055151-1055156 | 150, 3147, 3285, 3357-3358, 3426, 3495 |
| 36 | N/A | N/A | 210720 | 210755 | 47 | 96 | 80 | n.d. | 994702, 1055157-1055168 | 228, 3148-3149, 3217-3218, 3286-3287, 3359-3360, 3427-3429, 3496 |
| 37 | N/A | N/A | 212027 | 212056 | 69 | 90 | 80 | n.d. | 994703, 1055174-1055182 | 306, 3151-3152, 3220-3221, 3362, 3430-3431, 3498-3499 |
| 38 | N/A | N/A | 217274 | 217309 | 40 | 97 | 73 | n.d. | 994706, 1055186-1055197 | 540, 3153, 3222-3223, 3290-3291, 3364-3365, 3433-3434, 3500-3502 |
| 39 | N/A | N/A | 226995 | 227019 | 75 | 90 | 81 | n.d. | 994713, 1055208-1055212 | 463, 3156, 3226, 3294, 3368, 3436 |
| 40 | N/A | N/A | 251500 | 251533 | 68 | 94 | 83 | n.d. | 994717, 1055224-1055234 | 152, 3159-3160, 3229, 3297-3298, 3370-3371, 3439-3440, 3506-3507 |
| 41 | N/A | N/A | 284223 | 284260 | 96 | 99 | 98 | n.d. | 994731, 1055240-1055252 | 621, 3162, 3163, 3231, 3232, 3299, 3300, 3374, |

TABLE 1-continued

| ATXN1 Hotspots | | | | | | | | | |
|---|---|---|---|---|---|---|---|---|---|
| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
| 42 | N/A | N/A | 284331 | 284370 | 39 | 98 | 88 | n.d. | 994732, 1055253-1055266 | 3375, 3442, 3443, 3509, 3510 76, 3164-3166, 3233-3234, 3301-3302. 3376-3377, 3444-3446, 3511-3512 |
| 43 | N/A | N/A | 291004 | 291043 | 93 | 99 | 97 | n.d. | 994734, 1055268-1055281 | 232, 3167-3168, 3236-3237, 3303-3305, 3378-3379, 3447-3449, 3513-3514 |
| 44 | N/A | N/A | 296997 | 297034 | 73 | 99 | 95 | n.d. | 994735, 1055283-1055295 | 310, 3169-3170, 3238-3240, 3306-3307, 3380-3381, 3450-3451, 3516-3517 |
| 45 | N/A | N/A | 306737 | 306769 | 78 | 98 | 92 | n.d. | 994740, 1055300-1055305 | 77, 3171, 3241, 3309, 3383, 3453, 3519 |
| 46 | N/A | N/A | 318484 | 318519 | 88 | 99 | 96 | n.d. | 994743, 1041154, 1055310-1055317 | 311, 2143, 3173-3174, 3243, 3311, 3385, 3454-3455, 3520 |
| 47 | N/A | N/A | 332352 | 332391 | 54 | 99 | 90 | n.d. | 994756, 1055321-1055334 | 79, 3175-3177, 3245-3246, 3313-3314, 3387-3388, 3456-3458, 3521-3522 |
| 48 | N/A | N/A | 347813 | 347852 | 57 | 99 | 84 | n.d. | 994761, 1055337-1055350 | 469, 3178-3179, 3248-3249, 3316-3317, 3389-3391, 3459-3460, 3523-3525 |
| 49 | N/A | N/A | 437786 | 437815 | 74 | 97 | 91 | 12 | 1041316-1041322 | 2302, 2379, 2456, 2533, 2610, 2687, 2764 |
| 50 | N/A | N/A | 439429 | 439463 | 81 | 96 | 87 | 14 | 1041438-1041443, 1342051, 1342058, 1342043, 1342040 | 1844, 1921, 1998, 2075, 2152, 2229, 3547, 3572 |
| 51 | N/A | N/A | 442680 | 442711 | 78 | 93 | 87 | 30 | 1041636-1041639 | 2312, 2389, 2466, 2543 |
| 52 | N/A | N/A | 446727 | 446761 | 74 | 93 | 84 | n.d. | 1041936-1041941 | 782, 859, 936, 1013, 1090, 1167 |
| 53 | N/A | N/A | 446925 | 446970 | 59 | 91 | 77 | n.d. | 994871-994873, 1041961-1041966 | 327, 405, 483, 2707, 2784, 2861, 2938, 3015, 3092 |
| 54 | N/A | N/A | 451523 | 451560 | 82 | 95 | 89 | n.d. | 1042239-1042244 | 1946, 2023, 2100, 2177, 2254, 2331 |
| 55 | N/A | N/A | 451681 | 451718 | 72 | 91 | 83 | 0 | 1042253-1042258 | 715, 792, 869, 946, 3024, 3101 |

TABLE 1-continued

ATXN1 Hotspots

| Hot spot ID | SEQ ID NO: 1 Start Site | SEQ ID NO: 1 Stop Site | SEQ ID NO: 2 Start Site | SEQ ID NO: 2 Stop Site | Min. % Red. in vitro | Max. % Red. in vitro | Avg. % Red. in vitro | Avg. % Red. in vivo (ctx) | Compound No. in range | SEQ ID NO in range |
|---|---|---|---|---|---|---|---|---|---|---|
| 6 | 99 | 140 | 2609 | 2650 | 43 | 90 | 76 | n.d. | 994310-994313, 1054946-1054957 | 179, 257, 335, 413, 3111-3113, 3183, 3253-3254, 3321-3322, 3394-3395, 3464-3465 |

*Only a single compound tested in vitro; see in vivo column for average % reduction.

NONLIMITING DISCLOSURE AND INCORPORATION BY REFERENCE

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of an uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^m$CGAUCG," wherein $^m$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1H$ hydrogen atoms. Isotopic substitutions encompassed by the compounds herein include but are not limited to: $^2H$ or 3H in place of $^1H$, $^{13}C$ or $^{14}C$ in place of $^{12}C$, $^{15}N$ in place of $^{14}N$, $^{17}O$ or $^{18}O$ in place of $^{16}O$, and $^{33}S$, $^{34}S$, $^{35}S$, or $^{36}S$ in place of $^{32}S$. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphodiester linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or a salt thereof" expressly includes all such forms that may be fully or partially protonated/de-protonated/in association with a cation. In certain instances, one or more specific cation is identified. In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In certain such embodiments, the pH of the solution is adjusted with NaOH and/or HCl to achieve a desired pH.

Herein, certain specific doses are described. A dose may be in the form of a dosage unit. For clarity, a dose (or dosage unit) of a modified oligonucleotide or an oligomeric compound in milligrams indicates the mass of the free acid form of the modified oligonucleotide or oligomeric compound. As described above, in aqueous solution, the free acid is in equilibrium with anionic and salt forms. However, for the purpose of calculating dose, it is assumed that the modified oligonucleotide or oligomeric compound exists as a solvent-free, sodium-acetate free, anhydrous, free acid. For example, where a modified oligonucleotide or an oligomeric compound is in solution comprising sodium (e.g., saline), the modified oligonucleotide or oligomeric compound may be partially or fully de-protonated and in association with Na+ ions. However, the mass of the protons are nevertheless counted toward the weight of the dose, and the mass of the Na+ ions are not counted toward the weight of the dose. Thus, for example, a dose, or dosage unit, of 10 mg of Compound No. 1371311, equals the number of fully protonated molecules that weighs 10 mg. This would be equivalent to 10.59 mg of solvent-free, sodium acetate-free, anhydrous sodiated Compound No. 1371311. When an oligomeric compound comprises a conjugate group, the mass of the conjugate group is included in calculating the dose of such oligomeric compound. If the conjugate group also has an acid, the conjugate group is likewise assumed to be fully protonated for the purpose of calculating dose.

EXAMPLES

Example 1: Effect of 5-10-5 MOE Gapmer Modified Oligonucleotides on Human ATXN1 RNA In Vitro, Single Dose Modified oligonucleotides complementary to human ATXN1 nucleic acid were designed and tested for their single dose effects on ATXN1 mRNA in vitro. The modified oligonucleotides were tested in a series of experiments that had similar culture conditions.

The modified oligonucleotides in the tables below are 5-10-5 MOE gapmers with mixed PO/PS internucleoside linkages. The gapmers are 20 nucleosides in length, wherein the central gap segment consists of ten 2'-β-D-deoxynucleosides and the 3' and 5' wings each consist of five 2'-MOE modified nucleosides. The motif for the gapmers is (from 5' to 3'): eeeeedddddddddddeeeee; wherein "d" represents a 2'-β-D-deoxyribosyl sugar, and 'e' represents a 2'-MOE modified ribosyl sugar. The internucleoside linkage motif for the gapmers is (from 5' to 3'): sooossssssssssssooss; wherein 'o' represents a phosphodiester internucleoside linkage and 's' represents a phosphorothioate internucleoside linkage. Each cytosine residue is a 5-methyl cytosine.

"Start site" indicates the 5'-most nucleoside to which the modified oligonucleotide is complementary in the human gene sequence. "Stop site" indicates the 3'-most nucleoside to which the modified oligonucleotide is complementary in the human gene sequence. Each modified oligonucleotide listed in the Tables below is 100% complementary to SEQ ID NO: 1 (GENBANK Accession No. NM_000332.3), or SEQ ID NO: 2 (the complement of GENBANK Accession No. NC_000006.12 truncated from nucleotides 16296001 to 16764000). 'N/A' indicates that the modified oligonucleotide is not 100% complementary to that particular gene sequence.

Cultured A-431 cells were treated with modified oligonucleotide at a concentration of 4,000 nM by free uptake at a density of 10,000 cells per well for a treatment period of 48 hours. At the end of their treatment period, total RNA was isolated from the cells and ATXN1 RNA levels were measured by quantitative real-time RTPCR. ATXN1 RNA levels were measured by Human ATXN1 primer probe set RTS37573 (forward sequence CATCCAGAGTGCAGAGATAAGC, designated herein as SEQ ID NO: 11; reverse sequence ACTCTACCAAAACTTCAACGCT, designated herein as SEQ ID NO: 12; probe sequence AGAGGATTGAAGACAGCCATAGCCC, designated herein as SEQ ID NO: 13). ATXN1 RNA levels were normalized to total RNA content, as measured by RIBOGREEN® fluorescent RNA assay. Results are presented in the tables below as percent ATXN1 RNA levels relative to untreated control cells (% control). Each table represents results from an individual assay plate. The Compound No. marked with an asterisk (*) indicates that the modified oligonucleotide is complementary to the amplicon region of the primer probe set. Additional assays may be used to measure the potency and efficacy of the modified oligonucleotides complementary to the amplicon region.

TABLE 2

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994308 | 6 | 25 | 2516 | 2535 | CTGCGGTATACTCTGCTCTC | 96 | 23 |
| 994316 | 305 | 324 | 1076 | 10735 | GGAGGAGGAGATTGCTGTAC | 13 | 24 |
| 994324 | 435 | 454 | 106177 | 106196 | GTGCAGGCTGAAATCCACTC | 32 | 25 |
| 994332 | 691 | 710 | 277909 | 277928 | GTGTTCTTTCTTCCTTTCAC | 37 | 26 |
| 994340 | 959 | 978 | 435678 | 435697 | ATTTCATTTTTCGCCGTCCC | 53 | 27 |
| 994348 | 1190 | 1209 | 435909 | 435928 | CTTTGTGTAAACCTATTCCC | 29 | 28 |
| 994356 | 1881 | 1900 | 436600 | 436619 | TCAGCTTTCTTGGTGGCCTC | 103 | 29 |
| 994364 | 2264 | 2283 | 436983 | 437002 | GTGTGGTCTGAATGACCGTG | 76 | 30 |

TABLE 2-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994372 | 2728 | 2747 | 437447 | 437466 | GTCTTCCACCTTCTTTAGCT | 65 | 31 |
| 994380* | 2816 | 2835 | 437535 | 437554 | GGCTGTCTTCAATCCTCTCT | 4 | 32 |
| 994388 | 3139 | 3158 | 457392 | 457411 | TCCGTTTTCCTGCTCGGCAT | 32 | 33 |
| 994396 | 3398 | 3417 | 457651 | 457670 | ACTTGCCTACATTAGACCGG | 30 | 34 |
| 994404 | 3630 | 3649 | 457883 | 457902 | ACCGCTCCTGCTGTGCCCTT | 35 | 35 |
| 994412 | 4246 | 4265 | 458499 | 458518 | CGCTCTCTCCCTCTCCCCCA | 55 | 36 |
| 994420 | 4617 | 4636 | 458870 | 458889 | TGTTTTTGTTTTTTCCCCAA | 2 | 37 |
| 994428 | 4708 | 4727 | 458961 | 458980 | ATTGAAACTTTCAATATCTT | 50 | 38 |
| 994436 | 4858 | 4877 | 459111 | 459130 | CCCTTTTCTCTCAGTTTCTC | 37 | 39 |
| 994444 | 5428 | 5447 | 459681 | 459700 | TTTTTTTTAAAGCACTTTAA | 73 | 40 |
| 994452 | 5560 | 5579 | 459813 | 459832 | GATTTTTTTTTAATTTGTG | 72 | 41 |
| 994460 | 5980 | 5999 | 460233 | 460252 | TGTGTGTTTTTCTGAGTCCA | 4 | 42 |
| 994468 | 6050 | 6069 | 460303 | 460322 | GTGTTTTCCCATCTTAGTGT | 7 | 43 |
| 994476 | 6324 | 6343 | 460577 | 460596 | TGGGAGGCTCTCTCCCTCCT | 86 | 44 |
| 994484 | 6937 | 6956 | 461190 | 461209 | CGGTAAATATTGCAAAGTGG | 4 | 45 |
| 994492 | 7083 | 7102 | 461336 | 461355 | GTTTGTTGGTTTCTTATTAA | 5 | 46 |
| 994500 | 7217 | 7236 | 461470 | 461489 | GGCATCCATCTCTGTATCCC | 34 | 47 |
| 994508 | 7868 | 7887 | 462121 | 462140 | CATTGGAGATTTTCTCTCT | 17 | 48 |
| 994516 | 8196 | 8215 | 462449 | 462468 | TCTCTATTTCAGAAATTCTG | 34 | 49 |
| 994524 | 8379 | 8398 | 462632 | 462651 | ATCTATGTAAAAGAAATCTC | 58 | 50 |
| 994532 | 8542 | 8561 | 462795 | 462814 | AATTTTTTAAAACATTACCT | 57 | 51 |
| 994540 | 8764 | 8783 | 463017 | 463036 | GGTATAGTTTAAGAGCCTTT | 10 | 52 |
| 994548 | 9176 | 9195 | 463429 | 463448 | GCCTCTTTATATTAAATAAA | 76 | 53 |
| 994556 | 9296 | 9315 | 463549 | 463568 | TCTGAATTTAAGAATTGTAA | 52 | 54 |
| 994564 | 9707 | 9726 | 463960 | 463979 | ACCTAATACTTGGTATTCTG | 17 | 55 |
| 994572 | 10133 | 10152 | 464386 | 464405 | GTGTCTGTTTTCCCTTGGCC | 9 | 56 |
| 994580 | 10241 | 10260 | 464494 | 464513 | GTATGCACTTAAAATTTTCT | 11 | 57 |
| 994588 | 10381 | 10400 | 464634 | 464653 | ATAGAATATGAATTCTTCCA | 30 | 58 |
| 994596 | 10613 | 10632 | 464866 | 464885 | ATTGGCACTGTTATTTTATT | 48 | 59 |
| 994604 | N/A | N/A | 15633 | 15652 | GGCTCTTTAAATATTACTCC | 63 | 60 |
| 994612 | N/A | N/A | 31191 | 31210 | GTTTGACTAGATGTGCTTCT | 7 | 61 |
| 994620 | N/A | N/A | 41645 | 41664 | TCTTGAGCTTTTAATTTTAC | 22 | 62 |
| 994628 | N/A | N/A | 72785 | 72804 | TGCTCCTTTTATCATTGTCA | 16 | 63 |
| 994636 | N/A | N/A | 94229 | 94248 | CGGTGGTTTGTTGTACCCTT | 62 | 64 |

TABLE 2-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994644 | N/A | N/A | 111441 | 111460 | TGTACTCTATAATTTTTAA | 82 | 65 |
| 994652 | N/A | N/A | 134750 | 134769 | TGAGCTGCTTTTCATATTCT | 28 | 66 |
| 994660 | N/A | N/A | 148412<br>149523 | 148431<br>149542 | CAATAGACAAAAATTATCAT | 78 | 67 |
| 994668 | N/A | N/A | 148748<br>149859 | 148767<br>149878 | TTTCCGAAGCTGCTATATGT | 63 | 68 |
| 994676 | N/A | N/A | 155724 | 155743 | GTCTCTCTTTTTCTAAGTCA | 46 | 69 |
| 994684 | N/A | N/A | 169830<br>170088 | 169849<br>170107 | AGACTAATATATATATATAT | 52 | 70 |
| 994692 | N/A | N/A | 180504 | 180523 | GGGTCTCTTCATCTACCTTC | 61 | 71 |
| 994700 | N/A | N/A | 203037 | 203056 | TGTTCCTTTCTTCTTTGTTC | 21 | 72 |
| 994708 | N/A | N/A | 219463 | 219482 | GGGTGTGTATTCAATTCTCT | 59 | 73 |
| 994716 | N/A | N/A | 250181 | 250200 | GTGACTTTAAAGCTTTCCTG | 53 | 74 |
| 994724 | N/A | N/A | 269848<br>269877 | 269867<br>269896 | ACTGAGAGGCATCTCCAGTG | 86 | 75 |
| 994732 | N/A | N/A | 284341 | 284360 | TGTCAACTAGTTCTTATCAC | 7 | 76 |
| 994740 | N/A | N/A | 306740<br>306826 | 306759<br>306845 | GGTAAGGGCCACTAAATCTG | 5 | 77 |
| 994748 | N/A | N/A | 322467<br>323729 | 322486<br>323748 | CTTACCACAGAGACATGCCC | 56 | 78 |
| 994756 | N/A | N/A | 332362 | 332381 | GGAGTATTATAACAATTTGC | 5 | 79 |
| 994764 | N/A | N/A | 354092 | 354111 | GTCTGGGCTGATGATGCTGG | 16 | 80 |
| 994772 | N/A | N/A | 369873 | 369892 | GTCTGCCTTTAACATTTTTC | 25 | 81 |
| 994780 | N/A | N/A | 386759 | 386778 | TGTTGTTTATAAGTTTACGG | 12 | 82 |
| 994788 | N/A | N/A | 406846 | 406865 | TGCAGCTTATTTTATAGGTG | 8 | 83 |
| 994796 | N/A | N/A | 422947 | 422966 | CGGTGTCTTAATATCCTCAG | 32 | 84 |
| 994804 | N/A | N/A | 437891 | 437910 | GTTCCTCATCTTAATCACAG | 24 | 85 |
| 994812 | N/A | N/A | 439175 | 439194 | GTGACTCATCTTGGCTACAG | 32 | 86 |
| 994820 | N/A | N/A | 440213 | 440232 | ATTTTCCATGTGTCACCTGG | 34 | 87 |
| 994828 | N/A | N/A | 441396 | 441415 | GTGCAGTGTCAGCAGTGCCT | 44 | 88 |
| 994836 | N/A | N/A | 443271 | 443290 | GTTGTCTTACTGATCTGGAG | 12 | 89 |
| 994844 | N/A | N/A | 444292 | 444311 | TGAGACCTCTCTCTACTTGC | 43 | 90 |
| 994852 | N/A | N/A | 445329 | 445348 | TCAGTCCTTGGTGGAAGTGT | 50 | 91 |
| 994860 | N/A | N/A | 445809 | 445828 | TCTGTTGTTTAAATATGTCT | 49 | 92 |
| 994868 | N/A | N/A | 446320 | 446339 | TCTTTCATCTCTGGATGCCC | 42 | 93 |
| 994876 | N/A | N/A | 447587 | 447606 | GTGTTCTATCTCCAGAGTCT | 20 | 94 |
| 994884 | N/A | N/A | 448144 | 448163 | TGGTGAAGATAATGATGATC | 28 | 95 |
| 994892 | N/A | N/A | 449029 | 449048 | TCCAGTTTTAATAAAAGTTC | 61 | 96 |
| 994900 | N/A | N/A | 451116 | 451135 | ATTTTACTTAATTTTTACAA | 77 | 97 |
| 994908 | N/A | N/A | 452370 | 452389 | ATGTGCATATATACATAGAC | 23 | 98 |

TABLE 2-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994916 | N/A | N/A | 453097 | 453116 | CTTTTCTACTTCATCTTCTT | 61 | 99 |
| 994924 | N/A | N/A | 455432 | 455451 | GTGTTCTCTGGTGAGCCCCA | 59 | 100 |

TABLE 3

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994309 | 23 | 42 | 2533 | 2552 | TGTAGTAGAAATGATGTCTG | 75 | 101 |
| 994317 | 368 | 387 | 106110 | 106129 | AAATAGACTCTTTCACTATG | 41 | 102 |
| 994325 | 500 | 519 | 178110 | 178129 | GTGGCAGTGGAGAATCTCAG | 10 | 103 |
| 994333 | 761 | 780 | 277979 | 277998 | TCAGCCTATACTTCACCATG | 40 | 104 |
| 994341 | 965 | 984 | 435684 | 435703 | GGTTGGATTTCATTTTTCGC | 17 | 105 |
| 994349 | 1363 | 1382 | 436082 | 436101 | TCCACTGTATTGGGAGGACC | 73 | 106 |
| 994357 | 1882 | 1901 | 436601 | 436620 | CTCAGCTTTCTTGGTGGCCT | 93 | 107 |
| 994365 | 2455 | 2474 | 437174 | 437193 | CGCTTCCATGTCAGTGCTGC | 62 | 108 |
| 994373 | 2739 | 2758 | 437458 | 437477 | TCTGTTTTAAGTCTTCCAC | 35 | 109 |
| 994381* | 2848 | 2867 | 437567 | 437586 | GGCGAACTGTATCACGGCCA | 49 | 110 |
| 994389 | 3147 | 3166 | 457400 | 457419 | TGGTTGATTCCGTTTTCCTG | 63 | 111 |
| 994397 | 3467 | 3486 | 457720 | 457739 | CCTACAGTACAGTAATCTGG | 32 | 112 |
| 994405 | 3750 | 3769 | 458003 | 458022 | CACGGGACTTTTCTCCTGAC | 49 | 113 |
| 994413 | 4249 | 4268 | 458502 | 458521 | GTTCGCTCTCTCCCTCTCCC | 13 | 114 |
| 994421 | 4618 | 4637 | 458871 | 458890 | TTGTTTTTGTTTTTTCCCCA | 1 | 115 |
| 994429 | 4759 | 4778 | 459012 | 459031 | CATTTATTGTCACATACTAG | 19 | 116 |
| 994437 | 4922 | 4941 | 459175 | 459194 | GGTTCTTTAAAAGTTCATCT | 2 | 117 |
| 994445 | 5429 | 5448 | 459682 | 459701 | CTTTTTTTTAAAGCACTTTA | 37 | 118 |
| 994453 | 5571 | 5590 | 459824 | 459843 | GGTTGATACCAGATTTTTTT | 19 | 119 |
| 994461 | 5981 | 6000 | 460234 | 460253 | GTGTGTGTTTTTCTGAGTCC | 6 | 120 |
| 994469 | 6054 | 6073 | 460307 | 460326 | ATGTGTGTTTTCCCATCTTA | 8 | 121 |
| 994477 | 6421 | 6440 | 460674 | 460693 | GTCTCCTTGGCTGGCTCTTT | 21 | 122 |
| 994485 | 7018 | 7037 | 461271 | 461290 | GTGTTCCATTGTAAACGCAA | 36 | 123 |
| 994493 | 7087 | 7106 | 461340 | 461359 | TCTTGTTTGTTGGTTTCTTA | 3 | 124 |
| 994501 | 7243 | 7262 | 461496 | 461515 | TCCACTTTAAAAGATCTGAG | 18 | 125 |
| 994509 | 7892 | 7911 | 462145 | 462164 | GCACGGTATTAGTGTCTTCA | 6 | 126 |
| 994517 | 8204 | 8223 | 462457 | 462476 | TCTTAAATTCTCTATTTCAG | 34 | 127 |
| 994525 | 8487 | 8506 | 462740 | 462759 | TCTTCAGCTTCTCAAATCAG | 46 | 128 |

TABLE 3-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994533 | 8648 | 8667 | 462901 | 462920 | TCTGCTTTTTTTTTTTACA | 45 | 129 |
| 994541 | 8867 | 8886 | 463120 | 463139 | AAGTACTTTCAGCATAGGAA | 13 | 130 |
| 994549 | 9189 | 9208 | 463442 | 463461 | CGTATTTATTCTGGCCTCTT | 14 | 131 |
| 994557 | 9428 | 9447 | 463681 | 463700 | AATACAGTTGAACCATTTGT | 28 | 132 |
| 994565 | 9725 | 9744 | 463978 | 463997 | ACAGCTTGAGCTAGTGTCAC | 32 | 133 |
| 994573 | 10135 | 10154 | 464388 | 464407 | TGGTGTCTGTTTTCCCTTGG | 16 | 134 |
| 994581 | 10311 | 10330 | 464564 | 464583 | GGAATTACAGAGAGTATGCA | 11 | 135 |
| 994589 | 10506 | 10525 | 464759 | 464778 | GTTTTATTATAATAATGAAA | 76 | 136 |
| 994597 | 198 | 217 | 9914 | 9933 | GTAGTAGTTTTGTGAGGTA | 14 | 137 |
| 994605 | N/A | N/A | 17726 | 17745 | GTCACCTTTTCTATTTGCAC | 6 | 138 |
| 994613 | N/A | N/A | 33070 | 33089 | ATTTTGACTTTTGATTGGTG | 12 | 139 |
| 994621 | N/A | N/A | 44962 44984 | 44981 45003 | GGGACTCTGTCTTTATTTCC | 75 | 140 |
| 994629 | N/A | N/A | 77141 | 77160 | ATGTTTCTATCTAAGTCCCA | 40 | 141 |
| 994637 | N/A | N/A | 98148 | 98167 | GTGTGCATTTTTAATTTTGT | 55 | 142 |
| 994645 | N/A | N/A | 112180 | 112199 | TGAGGACATCATGATGGTGC | 20 | 143 |
| 994653 | N/A | N/A | 139451 | 139470 | GTTTTGTTTCAGTATTAGGT | 3 | 144 |
| 994661 | N/A | N/A | 148441 149552 | 148460 149571 | TACATCCTGAAAATCACAGC | 42 | 145 |
| 994669 | N/A | N/A | 148797 149908 | 148816 149927 | CTCTCACTTTTCTTCTCCTT | 59 | 146 |
| 994677 | N/A | N/A | 157700 | 157719 | GTCTCCTTACATAGTGCTGC | 42 | 147 |
| 994685 | N/A | N/A | 169837 169922 | 169856 169941 | ATATATTAGACTAATATATA | 86 | 148 |
| 994693 | N/A | N/A | 184184 | 184203 | TCAGGTTTATATGTATACAA | 7 | 149 |
| 994701 | N/A | N/A | 203893 | 203912 | GTTTGTTTAGATTTATCCTC | 5 | 150 |
| 994709 | N/A | N/A | 219913 | 219932 | GTCATAGCTCTCCTCTGCAC | 46 | 151 |
| 994717 | N/A | N/A | 251504 | 251523 | GTCAGCATACTTAGCTTTTC | 16 | 152 |
| 994725 | N/A | N/A | 269857 269886 | 269876 269905 | CAGGGCTGGACTGAGAGGCA | 58 | 153 |
| 994733 | N/A | N/A | 288893 | 288912 | TGAGACTATTATAGTTTCCA | 12 | 154 |
| 994741 | N/A | N/A | 308086 308110 | 308105 308129 | TAAAATGCACCAATCAACGC | 38 | 155 |
| 994749 | N/A | N/A | 328172 | 328191 | GTTACTTTATTTCTCTAGGG | 10 | 156 |
| 994757 | N/A | N/A | 333463 | 333482 | ATTTGTCTTGTTGTATGTTG | 15 | 157 |
| 994765 | N/A | N/A | 355633 | 355652 | GTTATTTAAATAGTGGCCT | 65 | 158 |
| 994773 | N/A | N/A | 369913 | 369932 | TCTTTGGCTTTTAGACCTGT | 35 | 159 |
| 994781 | N/A | N/A | 390011 | 390030 | ATGTTATATCAATGTTCTGT | 6 | 160 |
| 994789 | N/A | N/A | 413612 | 413631 | GTCTCAGCTCAAGAGTCTGT | 75 | 161 |
| 994797 | N/A | N/A | 430371 | 430390 | TGGCCTGTATATCTATGGAC | 75 | 162 |

TABLE 3-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
| --- | --- | --- | --- | --- | --- | --- | --- |
| 994805 | N/A | N/A | 438153 | 438172 | TCAGCCATAGCTCACTACAG | 26 | 163 |
| 994813 | N/A | N/A | 439396 | 439415 | GTCCCATTTGAATGTTTTCA | 15 | 164 |
| 994821 | N/A | N/A | 440225 | 440244 | TCACTCATGTTTATTTTCCA | 58 | 165 |
| 994829 | N/A | N/A | 441413 | 441432 | TCTGAATTTCTCTGTGGGTG | 11 | 166 |
| 994837 | N/A | N/A | 443454 | 443473 | TGTACTCTTCAGAGAAGCTG | 64 | 167 |
| 994845 | N/A | N/A | 444302 | 444321 | GTTAGGTGTGTGAGACCTCT | 61 | 168 |
| 994853 | N/A | N/A | 445380 | 445399 | TCTGTGAGTGTTCTATTTAA | 27 | 169 |
| 994861 | N/A | N/A | 445876 | 445895 | TGGTGCTATGTCTATATACA | 25 | 170 |
| 994869 | N/A | N/A | 446356 | 446375 | TGGCCTTTATACTTTTGTAA | 92 | 171 |
| 994877 | N/A | N/A | 447624 | 447643 | TGTATATTTGTCTGTTTTGC | 9 | 172 |
| 994885 | N/A | N/A | 448318 | 448337 | CTTCCTTTTTTATTTTGAG | 17 | 173 |
| 994893 | N/A | N/A | 449699 | 449718 | TCTTTATTTTATAATTAGGT | 63 | 174 |
| 994901 | N/A | N/A | 451209 | 451228 | TCTATGGTCCTCAGTCTCCT | 57 | 175 |
| 994909 | N/A | N/A | 452421 | 452440 | GTGACACTATTTGGTTTCAA | 59 | 176 |
| 994917 | N/A | N/A | 453098 | 453117 | GCTTTTCTACTTCATCTTCT | 59 | 177 |
| 994925 | N/A | N/A | 455497 | 455516 | TGGGCTTTTGATAGTGTTAA | 20 | 178 |

TABLE 4

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
| --- | --- | --- | --- | --- | --- | --- | --- |
| 994310 | 99 | 118 | 2609 | 2628 | GTTGCTCTGGCTGCTGCTCC | 23 | 179 |
| 994318 | 413 | 432 | 106155 | 106174 | TCTCTCTTGTTCCTGGTCTG | 9 | 180 |
| 994326 | 515 | 534 | 178125 | 178144 | GCTTGAGTAGAAAGGGTGGC | 40 | 181 |
| 994334 | 879 | 898 | 435598 | 435617 | GTCACATTTGATTTCTGTAG | 12 | 182 |
| 994342 | 966 | 985 | 435685 | 435704 | TGGTTGGATTTCATTTTTCG | 24 | 183 |
| 994350 | 1550 | 1569 | 436269 | 436288 | GCTGCTGCTGCTCAGCCTTG | 62 | 184 |
| 994358 | 1889 | 1908 | 436608 | 436627 | GGCTGCTCTCAGCTTTCTTG | 89 | 185 |
| 994366 | 2554 | 2573 | 437273 | 437292 | GTTGAAGTTCTCGCTCTTGG | 23 | 186 |
| 994374 | 2740 | 2759 | 437459 | 437478 | TTCTGTTTTTAAGTCTTCCA | 30 | 187 |
| 994382* | 2849 | 2868 | 437568 | 437587 | CGGCGAACTGTATCACGGCC | 30 | 188 |
| 994390 | 3154 | 3173 | 457407 | 457426 | ACTCCCCTGGTTGATTCCGT | 54 | 189 |
| 994398 | 3481 | 3500 | 457734 | 457753 | CTGTGTTATTTTAGCCTACA | 5 | 190 |
| 994406 | 3932 | 3951 | 458185 | 458204 | GTTCCTGATGTTGATTTTGC | 27 | 191 |
| 994414 | 4251 | 4270 | 458504 | 458523 | GTGTTCGCTCTCTCCCTCTC | 24 | 192 |

TABLE 4-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994422 | 4621 | 4640 | 458874 | 458893 | TTTTTGTTTTTGTTTTTCC | 14 | 193 |
| 994430 | 4762 | 4781 | 459015 | 459034 | GGTCATTTATTGTCACATAC | 2 | 194 |
| 994438 | 4971 | 4990 | 459224 | 459243 | ACTGCAGGAATATCACACAA | 54 | 195 |
| 994446 | 5485 | 5504 | 459738 | 459757 | GTTTAGTTGCAGCCATCCAA | 8 | 196 |
| 994454 | 5572 | 5591 | 459825 | 459844 | GGGTTGATACCAGATTTTTT | 29 | 197 |
| 994462 | 5983 | 6002 | 460236 | 460255 | TGGTGTGTGTTTTCTGAGT | 7 | 198 |
| 994470 | 6121 | 6140 | 460374 | 460393 | ATTTTATAATTCCTATACCT | 74 | 199 |
| 994478 | 6470 | 6489 | 460723 | 460742 | CATTCACTATTCCGTGTGGT | 41 | 200 |
| 994486 | 7024 | 7043 | 461277 | 461296 | GTGATTGTGTTCCATTGTAA | 5 | 201 |
| 994494 | 7088 | 7107 | 461341 | 461360 | TTCTTGTTTGTTGGTTTCTT | 5 | 202 |
| 994502 | 7384 | 7403 | 461637 | 461656 | TCACAATTCCAAGTTAGAAA | 16 | 203 |
| 994510 | 7930 | 7949 | 462183 | 462202 | GTACCGAGAGCTCTGCTTCC | 54 | 204 |
| 994518 | 8208 | 8227 | 462461 | 462480 | GTGTTCTTAAATTCTCTATT | 3 | 205 |
| 994526 | 8492 | 8511 | 462745 | 462764 | TGTTTTCTTCAGCTTCTCAA | 18 | 206 |
| 994534 | 8649 | 8668 | 462902 | 462921 | CTCTGCTTTTTTTTTTTAC | 45 | 207 |
| 994542 | 8893 | 8912 | 463146 | 463165 | GTTTAGACTAAGAAGGGAGC | 22 | 208 |
| 994550 | 9191 | 9210 | 463444 | 463463 | TCCGTATTTATTCTGGCCTC | 32 | 209 |
| 994558 | 9462 | 9481 | 463715 | 463734 | AGATACTACCTATTGGCCAA | 63 | 210 |
| 994566 | 9758 | 9777 | 464011 | 464030 | GCACCGAGCTTCTTGGTAAC | 60 | 211 |
| 994574 | 10139 | 10158 | 464392 | 464411 | GTTCTGGTGTCTGTTTTCCC | 8 | 212 |
| 994582 | 10328 | 10347 | 464581 | 464600 | GTACAATATTTTACACTGGA | 5 | 213 |
| 994590 | 10548 | 10567 | 464801 | 464820 | ATTTATTTAAAACAATTTTG | 86 | 214 |
| 994598 | 201 | 220 | 9917 | 9936 | CTTGTAGTAGTTTTTGTGAG | 36 | 215 |
| 994606 | N/A | N/A | 18215 18273 | 18234 18292 | GGAGGGTGCTTAGTCCTTCC | 69 | 216 |
| 994614 | N/A | N/A | 34101 355035 | 34120 355054 | GTTTGGCACACAGTAGGTGC | 29 | 217 |
| 994622 | N/A | N/A | 46490 | 46509 | GTGACTGCTGCTGATACCTG | 39 | 218 |
| 994630 | N/A | N/A | 85516 | 85535 | GTTTGATATGCTATGCTCAC | 26 | 219 |
| 994638 | N/A | N/A | 98883 | 98902 | TGTTTGGTTGAAGTATGTGG | 30 | 220 |
| 994646 | N/A | N/A | 115266 | 115285 | ATGTGGGTATTTAATGTTTC | 17 | 221 |
| 994654 | N/A | N/A | 140695 | 140714 | GTCTTTCTAAATGGTTGTAC | 31 | 222 |
| 994662 | N/A | N/A | 148489 149600 | 148508 149619 | TTCAGCATGATCTCAGTTCT | 25 | 223 |
| 994670 | N/A | N/A | 148889 150000 | 148908 150019 | ATGACATAATTCTAATAACT | 58 | 224 |
| 994678 | N/A | N/A | 159922 | 159941 | TCTCCTTATCTTGTCCTCTC | 47 | 225 |
| 994686 | N/A | N/A | 169926 170006 | 169945 170025 | TATTATATATTAGACTAATA | 81 | 226 |

TABLE 4-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994694 | N/A | N/A | 185906 | 185925 | GTTCTATTTTATAATAGTAG | 70 | 227 |
| 994702 | N/A | N/A | 210730 | 210749 | TGTGTAATACTCCATTTTTC | 18 | 228 |
| 994710 | N/A | N/A | 223261 | 223280 | GTTTGTGTTGTGTTTTACAG | 19 | 229 |
| 994718 | N/A | N/A | 251771 | 251790 | GTTTTCATACACAGTTCTTC | 23 | 230 |
| 994726 | N/A | N/A | 270287 | 270306 | ATTATATTACATTATACTTG | 100 | 231 |
| 994734 | N/A | N/A | 291014 | 291033 | TCCTGGGTTTTAGTTTTCC | 4 | 232 |
| 994742 | N/A | N/A | 310465 | 310484 | TGAGGATTACATCAGTGTAA | 4 | 233 |
| 994750 | N/A | N/A | 328842 | 328861 | TCTTGGGTAGATGAGGTTTG | 11 | 234 |
| 994758 | N/A | N/A | 337233 | 337252 | TCTTGTTTTTCCTTTCTTG | 25 | 235 |
| 994766 | N/A | N/A | 357070 | 357089 | GTCTCCTTTGTTCCGTGTAC | 21 | 236 |
| 994774 | N/A | N/A | 372154 | 372173 | GTCTTTTTATTTCTCTGCCC | 11 | 237 |
| 994782 | N/A | N/A | 396255<br>396277 | 396274<br>396296 | TTGCAAGAAGGTATGCCTAG | 61 | 238 |
| 994790 | N/A | N/A | 413815 | 413834 | TCCTGTTTACAACAAAGCTC | 66 | 239 |
| 994798 | N/A | N/A | 430661 | 430680 | TCTTTCTTTGCTATAATTTC | 84 | 240 |
| 994806 | N/A | N/A | 438267 | 438286 | GTCTGCTGATCTATCTGTTG | 20 | 241 |
| 994814 | N/A | N/A | 439492 | 439511 | ATTAGTTTATCTTTTTTTC | 78 | 242 |
| 994822 | N/A | N/A | 440914 | 440933 | CTGTCAGTAGAGAGATTTAG | 41 | 243 |
| 994830 | N/A | N/A | 441421 | 441440 | TGCACATTTCTGAATTTCTC | 13 | 244 |
| 994838 | N/A | N/A | 443819 | 443838 | GTACCAGCTAATCCATTCAA | 43 | 245 |
| 994846 | N/A | N/A | 444486 | 444505 | TGTTCTGTATAATAATGTAA | 60 | 246 |
| 994854 | N/A | N/A | 445456 | 445475 | CGAGAGACCCATTTACTGCA | 16 | 247 |
| 994862 | N/A | N/A | 446068 | 446087 | TGGGCTCATAATTATTTTT | 71 | 248 |
| 994870 | N/A | N/A | 446878 | 446897 | AAGTCATTTTATGATCTTGC | 55 | 249 |
| 994878 | N/A | N/A | 447631 | 447650 | ATTTACTTGTATATTTGTCT | 12 | 250 |
| 994886 | N/A | N/A | 448328 | 448347 | GTTTCCATAGCTTCCTTTTT | 37 | 251 |
| 994894 | N/A | N/A | 449737 | 449756 | TCTCAAATAGGTACACTCAA | 40 | 252 |
| 994902 | N/A | N/A | 451578 | 451597 | TTTTGTTTAAAGGGTTTTAC | 85 | 253 |
| 994910 | N/A | N/A | 452423 | 452442 | GTGTGACACTATTTGGTTTC | 49 | 254 |
| 994918 | N/A | N/A | 453104 | 453123 | ATTGTTGCTTTTCTACTTCA | 73 | 255 |
| 994926 | N/A | N/A | 455500 | 455519 | AAGTGGGCTTTTGATAGTGT | 20 | 256 |

TABLE 5

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994311 | 103 | 122 | 2613 | 2632 | TGCTGTTGCTCTGGCTGCTG | 62 | 257 |
| 994319 | 417 | 436 | 106159 | 106178 | TCTTTCTCTCTTGTTCCTGG | 5 | 258 |
| 994327 | 533 | 552 | 178143 | 178162 | TCTTTTCACGAAGATTTTGC | 22 | 259 |
| 994335 | 881 | 900 | 435600 | 435619 | AAGTCACATTTGATTTCTGT | 31 | 260 |
| 994343 | 969 | 988 | 435688 | 435707 | TCTTGGTTGGATTTCATTTT | 31 | 261 |
| 994351 | 1634 | 1653 | 436353 | 436372 | TGAGGTGCTGCTGCTGCTGC | 15 | 262 |
| 994359 | 1904 | 1923 | 436623 | 436642 | TGGCCTGCTGCAGCCGGCTG | 82 | 263 |
| 994367 | 2555 | 2574 | 437274 | 437293 | GGTTGAAGTTCTCGCTCTTG | 14 | 264 |
| 994375 | 2742 | 2761 | 437461 | 437480 | TCTTCTGTTTTAAGTCTTC | 30 | 265 |
| 994383 | 2952 | 2971 | 457205 | 457224 | TGGCTGGTTCTCTCCGGACA | 71 | 266 |
| 994391 | 3245 | 3264 | 457498 | 457517 | TGCTGGGTTCTATTTTGGTG | 38 | 267 |
| 994399 | 3490 | 3509 | 457743 | 457762 | ATGTAAATACTGTGTTATTT | 32 | 268 |
| 994407 | 3933 | 3952 | 458186 | 458205 | GGTTCCTGATGTTGATTTG | 33 | 269 |
| 994415 | 4254 | 4273 | 458507 | 458526 | TGGGTGTTCGCTCTCTCCCT | 37 | 270 |
| 994423 | 4636 | 4655 | 458889 | 458908 | AAAGCAACTTAGTTTTTTTT | 46 | 271 |
| 994431 | 4774 | 4793 | 459027 | 459046 | GTAGTACTTGGTGGTCATTT | 67 | 272 |
| 994439 | 5033 | 5052 | 459286 | 459305 | TGCTACATTTATTTATGCTC | 36 | 273 |
| 994447 | 5491 | 5510 | 459744 | 459763 | TGTTCAGTTTAGTTGCAGCC | 4 | 274 |
| 994455 | 5593 | 5612 | 459846 | 459865 | AATACTAGACAGCCAAAATG | 34 | 275 |
| 994463 | 5986 | 6005 | 460239 | 460258 | AGGTGGTGTGTGTTTTTCTG | 4 | 276 |
| 994471 | 6124 | 6143 | 460377 | 460396 | ATTATTTTATAATTCCTATA | 79 | 277 |
| 994479 | 6535 | 6554 | 460788 | 460807 | TCCAGGCTACATGGCTCCAG | 27 | 278 |
| 994487 | 7056 | 7075 | 461309 | 461328 | ATTTTTTTCTTTTCGCCCTG | 21 | 279 |
| 994495 | 7091 | 7110 | 461344 | 461363 | AGGTTCTTGTTTGTTGGTTT | 2 | 280 |
| 994503 | 7392 | 7411 | 461645 | 461664 | ATAGAGGCTCACAATTCCAA | 12 | 281 |
| 994511 | 8000 | 8019 | 462253 | 462272 | TGTTGAGCTGCTTGTGGTTC | 63 | 282 |
| 994519 | 8212 | 8231 | 462465 | 462484 | TGATGTGTTCTTAAATTCTC | 24 | 283 |
| 994527 | 8495 | 8514 | 462748 | 462767 | TTTTGTTTTCTTCAGCTTCT | 19 | 284 |
| 994535 | 8651 | 8670 | 462904 | 462923 | TTCTCTGCTTTTTTTTTTTT | 44 | 285 |
| 994543 | 8984 | 9003 | 463237 | 463256 | CAAGATTATATTCTTTGGGT | 11 | 286 |
| 994551 | 9194 | 9213 | 463447 | 463466 | TGCTCCGTATTTATTCTGGC | 3 | 287 |
| 994559 | 9472 | 9491 | 463725 | 463744 | GTTATTGTATAGATACTACC | 17 | 288 |
| 994567 | 9841 | 9860 | 464094 | 464113 | GCACTAACTAAAGGATTTAC | 14 | 289 |
| 994575 | 10146 | 10165 | 464399 | 464418 | AACCCAAGTTCTGGTGTCTG | 32 | 290 |
| 994583 | 10334 | 10353 | 464587 | 464606 | GTGCAAGTACAATATTTTAC | 5 | 291 |
| 994591 | 10601 | 10620 | 464854 | 464873 | ATTTTATTAGTACGAGTATA | 41 | 292 |
| 994599 | 204 | 223 | 9920 | 9939 | GTGCTTGTAGTAGTTTTTGT | 30 | 293 |

TABLE 5-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994607 | N/A | N/A | 18221 18279 | 18240 18298 | GTTAGTGGAGGGTGCTTAGT | 24 | 294 |
| 994615 | N/A | N/A | 39140 | 39159 | TCCTGTTATTTTGGTACTGG | 24 | 295 |
| 994623 | N/A | N/A | 47154 | 47173 | GTTTGCCTACTCCTGGTCTG | 28 | 296 |
| 994631 | N/A | N/A | 85766 | 85785 | GTTGACTATCTTATTTTTTC | 20 | 297 |
| 994639 | N/A | N/A | 99612 | 99631 | TCTTGCTTTTAATTTTTTTG | 37 | 298 |
| 994647 | N/A | N/A | 117178 | 117197 | GTTCACCTACATGTTTCCCC | 16 | 299 |
| 994655 | N/A | N/A | 144856 | 144875 | TCTTTTTTTTTAATTACAG | 79 | 300 |
| 994663 | N/A | N/A | 148529 149640 | 148548 149659 | TGGTGCACTCAGCTCTACCT | 62 | 301 |
| 994671 | N/A | N/A | 148965 150076 | 148984 150095 | AAAAATCCTGATCAAAAAAA | 76 | 302 |
| 994679 | N/A | N/A | 160587 | 160606 | GGCTCCATACTCCATTCTGT | 40 | 303 |
| 994687 | N/A | N/A | 170194 | 170213 | TGTATAATATTCCATTCTGT | 48 | 304 |
| 994695 | N/A | N/A | 185938 | 185957 | ATTTTATTACATTTTTCTTG | 77 | 305 |
| 994703 | N/A | N/A | 212031 | 212050 | TCTATGTTAGTCATTTCTCT | 98 | 306 |
| 994711 | N/A | N/A | 223958 | 223977 | TCTTGACATGATGTTTCCCT | 60 | 307 |
| 994719 | N/A | N/A | 256280 | 256299 | ATTACCTTAAAACTACCTTG | 54 | 308 |
| 994727 | N/A | N/A | 271835 271877 | 271854 271896 | TAAGCCATGCCTGGACTTCG | 55 | 309 |
| 994735 | N/A | N/A | 297005 | 297024 | GTTTGCATTAAATGACTGTG | 2 | 310 |
| 994743 | N/A | N/A | 318485 | 318504 | TGTTTGATATTTCTTTTTTT | 10 | 311 |
| 994751 | N/A | N/A | 328883 | 328902 | TCTTGGGTAACTAGATGATG | 15 | 312 |
| 994759 | N/A | N/A | 341935 | 341954 | GTTTTTTTTTTATTTGCCT | 4 | 313 |
| 994767 | N/A | N/A | 357089 | 357108 | GTCAGGTTATAATGACCCTG | 49 | 314 |
| 994775 | N/A | N/A | 376249 | 376268 | TCTTCTGTATTTAATTCTTC | 11 | 315 |
| 994783 | N/A | N/A | 396693 | 396712 | GTTATTGTGTTTATATTCAG | 10 | 316 |
| 994791 | N/A | N/A | 414662 | 414681 | TGGTGACATCTTGTTTCTAC | 15 | 317 |
| 994799 | N/A | N/A | 433785 | 433804 | TGAGCCACTGTGTGTAGCCA | 52 | 318 |
| 994807 | N/A | N/A | 438269 | 438288 | TTGTCTGCTGATCTATCTGT | 25 | 319 |
| 994815 | N/A | N/A | 439696 | 439715 | GTTTTTATTTTAAATTAG | 62 | 320 |
| 994823 | N/A | N/A | 441090 | 441109 | CCTTGCACTTTGTTTCTAC | 7 | 321 |
| 994831 | N/A | N/A | 442195 | 442214 | TCAGTACATGTTCATCTTAA | 10 | 322 |
| 994839 | N/A | N/A | 443918 | 443937 | CGGCATGTTCAATGTTGGCA | 14 | 323 |
| 994847 | N/A | N/A | 444822 | 444841 | GTGAGCTATTATGGTGTCAC | 101 | 324 |
| 994855 | N/A | N/A | 445546 | 445565 | GTCTGCTTTCCTGGAAGGCT | 37 | 325 |
| 994863 | N/A | N/A | 446159 | 446178 | ATCCCCTAAATCGACTCCT | 63 | 326 |
| 994871 | N/A | N/A | 446925 | 446944 | GTTATTTTCTCTCCACTCTC | 33 | 327 |

TABLE 5-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994879 | N/A | N/A | 447641 | 447660 | ATTCTTTTTATTTACTTGT | 43 | 328 |
| 994887 | N/A | N/A | 448332 | 448351 | TCTAGTTTCCATAGCTTCCT | 17 | 329 |
| 994895 | N/A | N/A | 450049 | 450068 | TCTTTGTTTCTTTTTGCCTA | 9 | 330 |
| 994903 | N/A | N/A | 451583 | 451602 | TCCATTTTGTTTAAAGGGT | 25 | 331 |
| 994911 | N/A | N/A | 452493 | 452512 | TGGTACAGATAATTGTGATG | 29 | 332 |
| 994919 | N/A | N/A | 453190 | 453209 | TGGATTTTATACACATTCAG | 49 | 333 |
| 994927 | N/A | N/A | 456737 | 456756 | CTTAGATTTTATGAGCTCAA | 21 | 334 |

TABLE 6

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994312 | 105 | 124 | 2615 | 2634 | GCTGCTGTTGCTCTGGCTGC | 46 | 335 |
| 994320 | 418 | 437 | 106160 | 106179 | CTCTTTCTCTCTTGTTCCTG | 7 | 336 |
| 994328 | 562 | 581 | 178172 | 178191 | ACCATAAGCTATCAGTTCCT | 8 | 337 |
| 994336 | 916 | 935 | 435635 | 435654 | GTCTGGATGGCTCTGATTTT | 39 | 338 |
| 994344 | 974 | 993 | 435693 | 435712 | TCCGCTCTTGGTTGGATTTC | 63 | 339 |
| 994352 | 1637 | 1656 | 436356 | 436375 | TGCTGAGGTGCTGCTGCTGC | 31 | 340 |
| 994360 | 1927 | 1946 | 436646 | 436665 | GTTCAGGACCTCCTTGGCCT | 69 | 341 |
| 994368 | 2560 | 2579 | 437279 | 437298 | CTCAGGGTTGAAGTTCTCGC | 36 | 342 |
| 994376* | 2758 | 2777 | 437477 | 437496 | TGCACTCTGGATGAAATCTT | 34 | 343 |
| 994384 | 3025 | 3044 | 457278 | 457297 | CTTCAGGTTCTTGAGGGTAA | 33 | 344 |
| 994392 | 3248 | 3267 | 457501 | 457520 | GCTTGCTGGGTTCTATTTTG | 93 | 345 |
| 994400 | 3546 | 3565 | 457799 | 457818 | CCTGCTGTAACTCTAATGAC | 40 | 346 |
| 994408 | 3987 | 4006 | 458240 | 458259 | TGGTTAACTTTCCAAATCTG | 16 | 347 |
| 994416 | 4283 | 4302 | 458536 | 458555 | GTTTTCCTAACACTGCACAG | 23 | 348 |
| 994424 | 4661 | 4680 | 458914 | 458933 | ATGTAGTTACAGTGTTGAAA | 5 | 349 |
| 994432 | 4777 | 4796 | 459030 | 459049 | CAGGTAGTACTTGGTGGTCA | 76 | 350 |
| 994440 | 5037 | 5056 | 459290 | 459309 | ATTTGCTACATTTATTTAT | 53 | 351 |
| 994448 | 5496 | 5515 | 459749 | 459768 | GTATTTGTTCAGTTTAGTTG | 5 | 352 |
| 994456 | 5682 | 5701 | 459935 | 459954 | GCTATTCTAAACCTATTCAA | 75 | 353 |
| 994464 | 6029 | 6048 | 460282 | 460301 | GGTTTAGTGGATCCAGTCAA | 7 | 354 |
| 994472 | 6143 | 6162 | 460396 | 460415 | AAGTGTTTAGAAAGAACCAA | 41 | 355 |
| 994480 | 6702 | 6721 | 460955 | 460974 | TGGCAGGTGGTCCCCTCCAC | 68 | 356 |
| 994488 | 7064 | 7083 | 461317 | 461336 | ATAGTATTATTTTTTCTTT | 68 | 357 |
| 994496 | 7095 | 7114 | 461348 | 461367 | AGAGAGGTTCTTGTTTGTTG | 6 | 358 |

TABLE 6-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994504 | 7447 | 7466 | 461700 | 461719 | TGCTGCCACTTCCTGGTGGG | 87 | 359 |
| 994512 | 8003 | 8022 | 462256 | 462275 | GTCTGTTGAGCTGCTTGTGG | 32 | 360 |
| 994520 | 8230 | 8249 | 462483 | 462502 | CTCTGTATATTTATTACTTG | 5 | 361 |
| 994528 | 8496 | 8515 | 462749 | 462768 | ATTTTGTTTTCTTCAGCTTC | 34 | 362 |
| 994536 | 8653 | 8672 | 462906 | 462925 | CCTTCTCTGCTTTTTTTTTT | 73 | 363 |
| 994544 | 8987 | 9006 | 463240 | 463259 | GTTCAAGATTATATTCTTTG | 21 | 364 |
| 994552 | 9235 | 9254 | 463488 | 463507 | GTCCGGCTTGATTTTTGGAC | 78 | 365 |
| 994560 | 9477 | 9496 | 463730 | 463749 | TTGTTGTTATTGTATAGATA | 21 | 366 |
| 994568 | 9935 | 9954 | 464188 | 464207 | TTTAGAGTTGAGCAGTTCAG | 20 | 367 |
| 994576 | 10167 | 10186 | 464420 | 464439 | TGTCAGTCTGGTAGTGCCCT | 18 | 368 |
| 994584 | 10362 | 10381 | 464615 | 464634 | ATTTTTTAATATTTGTTTAA | 75 | 369 |
| 994592 | 10604 | 10623 | 464857 | 464876 | GTTATTTTATTAGTACGAGT | 25 | 370 |
| 994600 | 205 | 224 | 9921 | 9940 | GGTGCTTGTAGTAGTTTTTG | 27 | 371 |
| 994608 | N/A | N/A | 22131 | 22150 | TCCTCCTTTTATATCTGTTT | 72 | 372 |
| 994616 | N/A | N/A | 39208 | 39227 | GTTTGATTACTGTCATGACT | 36 | 373 |
| 994624 | N/A | N/A | 51696 51749 | 51715 51768 | GTGAAAAGAAAGATGTACTT | 82 | 374 |
| 994632 | N/A | N/A | 85767 | 85786 | CGTTGACTATCTTATTTTTT | 26 | 375 |
| 994640 | N/A | N/A | 103358 | 103377 | TCTCAATTATAATTTGTTTT | 71 | 376 |
| 994648 | N/A | N/A | 118549 | 118568 | GTTTCCTTAAAAGCAACTGT | 24 | 377 |
| 994656 | N/A | N/A | 148250 149361 | 148269 149380 | AGAGTCAATGATTAAATTCA | 29 | 378 |
| 994664 | N/A | N/A | 148584 149695 | 148603 149714 | CATGACTCTTTCTTAAGAAT | 49 | 379 |
| 994672 | N/A | N/A | 149011 150122 | 149030 150141 | AAATTTTCTAGAAACATTAA | 60 | 380 |
| 994680 | N/A | N/A | 160737 | 160756 | GTTACCATTCTCCTTTCCCC | 50 | 381 |
| 994688 | N/A | N/A | 170872 170939 | 170891 170958 | TGCTAGCTACAGAGCACTGA | 122 | 382 |
| 994696 | N/A | N/A | 188547 | 188566 | CGTTGGATATTTTATTCTTT | 2 | 383 |
| 994704 | N/A | N/A | 213149 | 213168 | ATGTTTGTATTCCATATTTG | 20 | 384 |
| 994712 | N/A | N/A | 224696 | 224715 | TCTTTTCATCTTCAGCTCTG | 50 | 385 |
| 994720 | N/A | N/A | 264945 | 264964 | GTTTGTGCTTTTGGTGTCAC | 14 | 386 |
| 994728 | N/A | N/A | 275360 | 275379 | GTTTGCTTTCTTCATCCTAC | 45 | 387 |
| 994736 | N/A | N/A | 299651 308026 | 299670 308045 | AATCGCAGGGAGGATTGAAA | 47 | 388 |
| 994744 | N/A | N/A | 318885 | 318904 | TGACCTTTATTTGGATCTTG | 26 | 389 |
| 994752 | N/A | N/A | 329899 | 329918 | TGGCATTTATAATATTTGTG | 2 | 390 |
| 994760 | N/A | N/A | 347724 | 347743 | ATTTTCTTAGAAGGATCTCT | 10 | 391 |

TABLE 6-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994768 | N/A | N/A | 359649 | 359668 | GTTTGAACTGAGCATGTTTT | 17 | 392 |
| 994776 | N/A | N/A | 380393 | 380412 | TGGTCATTAGATCATGCTAC | 31 | 393 |
| 994784 | N/A | N/A | 396974 | 396993 | TGTAGCTTTTAGTGACTTTG | 11 | 394 |
| 994792 | N/A | N/A | 415670 | 415689 | ATTTTGGCTTTCCATAGTGT | 44 | 395 |
| 994800 | N/A | N/A | 434146 | 434165 | GTTACTGCTGCTGTGTGGGC | 64 | 396 |
| 994808 | N/A | N/A | 439027 | 439046 | CTAGGATTAGCTAATTCCTA | 78 | 397 |
| 994816 | N/A | N/A | 439709 | 439728 | TCTCTACTAAAATGTTTTTT | 43 | 398 |
| 994824 | N/A | N/A | 441169 | 441188 | GGAGTATTTTAGCTGTGATG | 6 | 399 |
| 994832 | N/A | N/A | 442536 | 442555 | GCTTCCTTTGGTGCACGCAG | 34 | 400 |
| 994840 | N/A | N/A | 444077 | 444096 | GTTTGACATAGTTTCTCTGT | 15 | 401 |
| 994848 | N/A | N/A | 444899 | 444918 | TGGTGTGTACTTGTGGTCCC | 49 | 402 |
| 994856 | N/A | N/A | 445653 | 445672 | GTTTCAGTAAGTATGTCTTG | 11 | 403 |
| 994864 | N/A | N/A | 446193 | 446212 | GTTATAAGAGATCTGCCTAC | 70 | 404 |
| 994872 | N/A | N/A | 446936 | 446955 | ATCACACTTCAGTTATTTTC | 31 | 405 |
| 994880 | N/A | N/A | 447652 | 447671 | TCTTCTTATGCATTCTTTTT | 29 | 406 |
| 994888 | N/A | N/A | 448391 | 448410 | CCACCCACTGTCCTTTTCAG | 58 | 407 |
| 994896 | N/A | N/A | 450077 | 450096 | ATTCTTCTTTAATCACTTCA | 55 | 408 |
| 994904 | N/A | N/A | 452108 | 452127 | GTTTGCTTATTCTTGCCCAA | 11 | 409 |
| 994912 | N/A | N/A | 452497 | 452516 | TCCATGGTACAGATAATTGT | 53 | 410 |
| 994920 | N/A | N/A | 453505 | 453524 | GTTGGATTCTTTTTTTCTTT | 5 | 411 |
| 994928 | N/A | N/A | 456851 | 456870 | TCTATAGCTGGTCTCTGTTA | 54 | 412 |

TABLE 7

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994313 | 111 | 130 | 2621 | 2640 | CTTGCGGCTGCTGTTGCTCT | 28 | 413 |
| 994321 | 419 | 438 | 106161 | 106180 | ACTCTTTCTCTCTTGTTCCT | 7 | 414 |
| 994329 | 590 | 609 | 178200 | 178219 | GTACCATGTGCTTTCATCAC | 11 | 415 |
| 994337 | 924 | 943 | 435643 | 435662 | GTTTCACTGTCTGGATGGCT | 21 | 416 |
| 994345 | 977 | 996 | 435696 | 435715 | TGCTCCGCTCTTGGTTGGAT | 57 | 417 |
| 994353 | 1693 | 1712 | 436412 | 436431 | GTACTGGTTCTGCTGGGCTG | 32 | 418 |
| 994361 | 1949 | 1968 | 436668 | 436687 | GCCGGCTCTTCTCCATCTCA | 87 | 419 |
| 994369 | 2720 | 2739 | 437439 | 437458 | CCTTCTTTAGCTCCCCGTTG | 48 | 420 |
| 994377* | 2768 | 2787 | 437487 | 437506 | TGCTTATCTCTGCACTCTGG | 6 | 421 |
| 994385 | 3034 | 3053 | 457287 | 457306 | AGAGCCGTTCTTCAGGTTCT | 90 | 422 |

TABLE 7-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994393 | 3279 | 3298 | 457532 | 457551 | GCCGACCACCTCCTCTTCCT | 89 | 423 |
| 994401 | 3568 | 3587 | 457821 | 457840 | TGCACCAGTCTCCTGCGACA | 41 | 424 |
| 994409 | 3999 | 4018 | 458252 | 458271 | TGTTCTTTTAAATGGTTAAC | 17 | 425 |
| 994417 | 4330 | 4349 | 458583 | 458602 | GTTTGCATCTACCTCTTGGG | 14 | 426 |
| 994425 | 4673 | 4692 | 458926 | 458945 | TGCAGAGCTGAAATGTAGTT | 38 | 427 |
| 994433 | 4780 | 4799 | 459033 | 459052 | CGTCAGGTAGTACTTGGTGG | 55 | 428 |
| 994441 | 5069 | 5088 | 459322 | 459341 | AATGGCCTAGAGTTTAGGCA | 81 | 429 |
| 994449 | 5499 | 5518 | 459752 | 459771 | CAGGTATTTGTTCAGTTTAG | 3 | 430 |
| 994457 | 5905 | 5924 | 460158 | 460177 | TCCTCTTACCATCAAAGGCT | 45 | 431 |
| 994465 | 6033 | 6052 | 460286 | 460305 | TGTTGGTTTAGTGGATCCAG | 13 | 432 |
| 994473 | 6194 | 6213 | 460447 | 460466 | TGGCACAGAAAGTATTGCAC | 34 | 433 |
| 994481 | 6716 | 6735 | 460969 | 460988 | GTGGTGACCGTGGGTGGCAG | 84 | 434 |
| 994489 | 7075 | 7094 | 461328 | 461347 | GTTTCTTATTAATAGTATTA | 38 | 435 |
| 994497 | 7125 | 7144 | 461378 | 461397 | GTCATTTTATATATTTAGAA | 74 | 436 |
| 994505 | 7454 | 7473 | 461707 | 461726 | GGAGGGATGCTGCCACTTCC | 67 | 437 |
| 994513 | 8005 | 8024 | 462258 | 462277 | CAGTCTGTTGAGCTGCTTGT | 55 | 438 |
| 994521 | 8232 | 8251 | 462485 | 462504 | TTCTCTGTATATTTATTACT | 42 | 439 |
| 994529 | 8503 | 8522 | 462756 | 462775 | CTTCAAAATTTTGTTTTCTT | 38 | 440 |
| 994537 | 8693 | 8712 | 462946 | 462965 | TGACAAATTTCTATATACAA | 66 | 441 |
| 994545 | 9036 | 9055 | 463289 | 463308 | TGAGTCCTGTTTGATTGGTA | 8 | 442 |
| 994553 | 9244 | 9263 | 463497 | 463516 | GTTTCCACTGTCCGGCTTGA | 29 | 443 |
| 994561 | 9486 | 9505 | 463739 | 463758 | TCTTAGAGATTGTTGTTATT | 12 | 444 |
| 994569 | 9942 | 9961 | 464195 | 464214 | ATTTGGGTTTAGAGTTGAGC | 6 | 445 |
| 994577 | 10193 | 10212 | 464446 | 464465 | TCCCTAGTTCTCCTCTGTAC | 74 | 446 |
| 994585 | 10365 | 10384 | 464618 | 464637 | TCCATTTTTAATATTTGTT | 27 | 447 |
| 994593 | 10606 | 10625 | 464859 | 464878 | CTGTTATTTTATTAGTACGA | 42 | 448 |
| 994601 | 206 | 225 | 9922 | 9941 | TGGTGCTTGTAGTAGTTTTT | 33 | 449 |
| 994609 | N/A | N/A | 22231 | 22250 | TCTTCATTTTAATGTTGTTT | 13 | 450 |
| 994617 | N/A | N/A | 39411 | 39430 | TCTGCTCTAAAACTTTCTAC | 55 | 451 |
| 994625 | N/A | N/A | 51702 51755 | 51721 51774 | TTATTAGTGAAAAGAAAGAT | 43 | 452 |
| 994633 | N/A | N/A | 86196 | 86215 | ATTCAGATATAATTGTTTAC | 69 | 453 |
| 994641 | N/A | N/A | 105012 | 105031 | GTGTGAATAACTAATTCCTT | 53 | 454 |
| 994649 | N/A | N/A | 120191 | 120210 | TGTTTGATAAATGTTATTCT | 11 | 455 |
| 994657 | N/A | N/A | 148273 149384 | 148292 149403 | TATTATATTAAAAGTTAAAA | 62 | 456 |
| 994665 | N/A | N/A | 148615 149726 | 148634 149745 | AGAGGCTTCTGGAAATCCCC | 49 | 457 |

TABLE 7-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994673 | N/A | N/A | 149065 150161 | 149084 150180 | CCTGTCTTGATAAAATAAAA | 96 | 458 |
| 994681 | N/A | N/A | 162490 | 162509 | TGCATCTATTTTCTATTCTG | 96 | 459 |
| 994689 | N/A | N/A | 176036 176352 | 176055 176371 | GAAAATTCCTACTCATTTTT | 99 | 460 |
| 994697 | N/A | N/A | 189098 | 189117 | GTTTCTGCTAATCTGTGACA | 31 | 461 |
| 994705 | N/A | N/A | 214840 | 214859 | GTTTGCAGTTAACTTTTTTT | 34 | 462 |
| 994713 | N/A | N/A | 226996 | 227015 | TGGTTATTTACTCATTCTAC | 19 | 463 |
| 994721 | N/A | N/A | 265218 | 265237 | TCTTTTCATAAGCTTATTGG | 71 | 464 |
| 994729 | N/A | N/A | 279331 | 279350 | GTCTGCTTTCAATGAAGCAC | 69 | 465 |
| 994737 | N/A | N/A | 299784 299827 | 299803 299846 | ACTTTCCTGTCTTACAAGAG | 19 | 466 |
| 994745 | N/A | N/A | 320275 | 320294 | GTGAGAACTGCTATTTTCAG | 7 | 467 |
| 994753 | N/A | N/A | 330357 | 330376 | TCAGCTGTACAGCTCCTTAC | 55 | 468 |
| 994761 | N/A | N/A | 347823 | 347842 | TGGTCATTATCTAGTTTCTG | 5 | 469 |
| 994769 | N/A | N/A | 365364 | 365383 | GTGTGTCTAGTTTGTTTTTC | 20 | 470 |
| 994777 | N/A | N/A | 380610 | 380629 | GTTATATATTTCCTATTTTC | 34 | 471 |
| 994785 | N/A | N/A | 398119 | 398138 | TCTATATATTAATCATTTCC | 68 | 472 |
| 994793 | N/A | N/A | 417738 | 417757 | GGGTTATATCATGTTGGCCA | 67 | 473 |
| 994801 | N/A | N/A | 437630 | 437649 | CGGTGTGGTGTCCCATCCCT | 71 | 474 |
| 994809 | N/A | N/A | 439072 | 439091 | CTTTGATATTTAGTGTCTT | 12 | 475 |
| 994817 | N/A | N/A | 440059 | 440078 | TCCTGATTTTCTTTTTTTTT | 49 | 476 |
| 994825 | N/A | N/A | 441229 | 441248 | TGCTCTCTGTCTGAGTCTCC | 68 | 477 |
| 994833 | N/A | N/A | 442847 | 442866 | GTGCCAGTTCCTGCATTTTC | 43 | 478 |
| 994841 | N/A | N/A | 444080 | 444099 | GTGGTTTGACATAGTTTCTC | 6 | 479 |
| 994849 | N/A | N/A | 445236 | 445255 | GTTTTTCTTACACATGGTAG | 23 | 480 |
| 994857 | N/A | N/A | 445654 | 445673 | GGTTTCAGTAAGTATGTCTT | 8 | 481 |
| 994865 | N/A | N/A | 446197 | 446216 | TGTGGTTATAAGAGATCTGC | 28 | 482 |
| 994873 | N/A | N/A | 446951 | 446970 | TCATGATTTTATTGAATCAC | 26 | 483 |
| 994881 | N/A | N/A | 447992 | 448011 | TCTTTATACCAGGGATCCCC | 154 | 484 |
| 994889 | N/A | N/A | 448705 | 448724 | TCATACTTTCTTCCGCTCTT | 38 | 485 |
| 994897 | N/A | N/A | 450234 | 450253 | GGGTTTCATTCACCATGTTG | 47 | 486 |
| 994905 | N/A | N/A | 452110 | 452129 | CGGTTTGCTTATTCTTGCCC | 43 | 487 |
| 994913 | N/A | N/A | 452653 | 452672 | ATTTTCTTTTTCTGTGCCT | 9 | 488 |
| 994921 | N/A | N/A | 453506 | 453525 | TGTTGGATTCTTTTTTCTT | 12 | 489 |
| 994929 | N/A | N/A | 456930 | 456949 | TGGGTTGTACCTCTACTTGC | 69 | 490 |

TABLE 8

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994314 | 246 | 265 | 10657 | 10676 | TGGTGACTTGATGCACGATG | 10 | 491 |
| 994322 | 422 | 441 | 106164 | 106183 | TCCACTCTTTCTCTCTTGTT | 17 | 492 |
| 994330 | 687 | 706 | 277905 | 277924 | TCTTTCTTCCTTTCACAGAG | 35 | 493 |
| 994338 | 930 | 949 | 435649 | 435668 | GTGACTGTTTCACTGTCTGG | 79 | 494 |
| 994346 | 980 | 999 | 435699 | 435718 | CGTTGCTCCGCTCTTGGTTG | 47 | 495 |
| 994354 | 1870 | 1889 | 436589 | 436608 | GGTGGCCTCCCGAGGGACAA | 76 | 496 |
| 994362 | 2074 | 2093 | 436793 | 436812 | ATCACGACTGCTGTAGTCTG | 42 | 497 |
| 994370 | 2724 | 2743 | 437443 | 437462 | TCCACCTTCTTTAGCTCCCC | 71 | 498 |
| 994378* | 2771 | 2790 | 437490 | 437509 | CGTTGCTTATCTCTGCACTC | 16 | 499 |
| 994386 | 3115 | 3134 | 457368 | 457387 | GTGTCTGCTGCCCGCCAGGC | 77 | 500 |
| 994394 | 3310 | 3329 | 457563 | 457582 | TTCTGACTTCTCCAGTTTGC | 75 | 501 |
| 994402 | 3618 | 3637 | 457871 | 457890 | GTGCCCTTCCTCCCGCCCGC | 77 | 502 |
| 994410 | 4028 | 4047 | 458281 | 458300 | TTTATTGTAAAATATGTTGG | 71 | 503 |
| 994418 | 4334 | 4353 | 458587 | 458606 | GGCAGTTTGCATCTACCTCT | 19 | 504 |
| 994426 | 4691 | 4710 | 458944 | 458963 | CTTGCTCTTCAGCAATTCTG | 52 | 505 |
| 994434 | 4824 | 4843 | 459077 | 459096 | ATGCCTTGAACTGATTCTCA | 13 | 506 |
| 994442 | 5218 | 5237 | 459471 | 459490 | CTCACATATATAAATGTCTT | 17 | 507 |
| 994450 | 5532 | 5551 | 459785 | 459804 | AAAGTACTATTTTCAATGGG | 23 | 508 |
| 994458 | 5915 | 5934 | 460168 | 460187 | CAGCCCGTATTCCTCTTACC | 19 | 509 |
| 994466 | 6034 | 6053 | 460287 | 460306 | GTGTTGGTTTAGTGGATCCA | 22 | 510 |
| 994474 | 6208 | 6227 | 460461 | 460480 | TGGTCAGACTCTATTGGCAC | 36 | 511 |
| 994482 | 6842 | 6861 | 461095 | 461114 | TGTTTGCTACACAGAAGCGG | 61 | 512 |
| 994490 | 7077 | 7096 | 461330 | 461349 | TGGTTTCTTATTAATAGTAT | 24 | 513 |
| 994498 | 7127 | 7146 | 461380 | 461399 | CAGTCATTTTATATATTTAG | 44 | 514 |
| 994506 | 7707 | 7726 | 461960 | 461979 | GTGCAAAGAGTGGATTTTAT | 6 | 515 |
| 994514 | 8063 | 8082 | 462316 | 462335 | TGGCCCTGTTTTCACCTGGT | 76 | 516 |
| 994522 | 8333 | 8352 | 462586 | 462605 | GTTTGGAGTTTCCCTATGCC | 13 | 517 |
| 994530 | 8509 | 8528 | 462762 | 462781 | TGAGTGCTTCAAAATTTTGT | 42 | 518 |
| 994538 | 8741 | 8760 | 462994 | 463013 | GTAGTAATTCTTCCAGGCCA | 25 | 519 |
| 994546 | 9047 | 9066 | 463300 | 463319 | TGTCCCCATAATGAGTCCTG | 32 | 520 |
| 994554 | 9249 | 9268 | 463502 | 463521 | GTCCAGTTTCCACTGTCCGG | 49 | 521 |
| 994562 | 9685 | 9704 | 463938 | 463957 | GGACAGTATGTTATCTTGGT | 8 | 522 |
| 994570 | 9953 | 9972 | 464206 | 464225 | GGCTGACACTAATTTGGGTT | 22 | 523 |
| 994578 | 10196 | 10215 | 464449 | 464468 | CCTTCCCTAGTTCTCCTCTG | 24 | 524 |
| 994586 | 10367 | 10386 | 464620 | 464639 | CTTCCATTTTTTAATATTTG | 38 | 525 |

TABLE 8-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994594 | 10608 | 10627 | 464861 | 464880 | CACTGTTATTTTATTAGTAC | 77 | 526 |
| 994602 | N/A | N/A | 5488 6515 | 5507 6534 | ATAAAAGTTGAGTAGCTAGA | 68 | 527 |
| 994610 | N/A | N/A | 28064 | 28083 | TCCGCATTATTTTCCCTGC | 9 | 528 |
| 994618 | N/A | N/A | 40728 | 40747 | TCCTACTTTTAAGTTTCCAG | 10 | 529 |
| 994626 | N/A | N/A | 51710 51763 | 51729 51782 | AAACTAATTTATTAGTGAAA | 94 | 530 |
| 994634 | N/A | N/A | 86436 | 86455 | TGTATAGTAGAATTTTTTT | 77 | 531 |
| 994642 | N/A | N/A | 106495 | 106514 | GTGTGTTTAGTTGTTGGGT | 3 | 532 |
| 994650 | N/A | N/A | 122443 | 122462 | GTTGAGACTTAATTGCTCAG | 67 | 533 |
| 994658 | N/A | N/A | 149437 148326 | 149456 148345 | GAATACTATGTATTTGCCAC | 14 | 534 |
| 994666 | N/A | N/A | 149806 148695 | 149825 148714 | TTTTGACAAGTCAGTCTTTT | 87 | 535 |
| 994674 | N/A | N/A | 155493 | 155512 | GTTTCCTTAAAATATGTTGG | 9 | 536 |
| 994682 | N/A | N/A | 163871 | 163890 | TCCATTGTATATGTATCTGT | 26 | 537 |
| 994690 | N/A | N/A | 179789 | 179808 | GTTATATTTAATCATGTTCC | 13 | 538 |
| 994698 | N/A | N/A | 189111 | 189130 | GTCATATTTCTTAGTTTCTG | 4 | 539 |
| 994706 | N/A | N/A | 217284 | 217303 | GTTATGTTTAAGGTATTTTC | 21 | 540 |
| 994714 | N/A | N/A | 234290 | 234309 | CGTCGGATAAATTTATCCAC | 80 | 541 |
| 994722 | N/A | N/A | 265414 | 265433 | GTTTTCTATAGTGATTGCAC | 44 | 542 |
| 994730 | N/A | N/A | 281189 | 281208 | TCTTTTTTTCTTTTAACCCT | 6 | 543 |
| 994738 | N/A | N/A | 299793 308168 | 299812 308187 | CAATCAGGAACTTTCCTGTC | 65 | 544 |
| 994746 | N/A | N/A | 322234 323496 | 322253 323515 | AGGAACACAAGAGGGAATAC | 53 | 545 |
| 994754 | N/A | N/A | 331549 | 331568 | TCTTTCCTAAAGCTTATTAG | 52 | 546 |
| 994762 | N/A | N/A | 352034 | 352053 | GTTTTAACTCAGCTCTCTCT | 53 | 547 |
| 994770 | N/A | N/A | 366558 | 366577 | CGGCTAGTATTTATATTTTT | 48 | 548 |
| 994778 | N/A | N/A | 382060 | 382079 | GTCTACATTTATAGATTTAG | 11 | 549 |
| 994786 | N/A | N/A | 400669 | 400688 | GTGTTACATAAATTAATTCC | 14 | 550 |
| 994794 | N/A | N/A | 418949 | 418968 | GTTACTGTTCTTATCTTGTG | 47 | 551 |
| 994802 | N/A | N/A | 437850 | 437869 | GGTGAGTTTCTGGATTGTCT | 7 | 552 |
| 994810 | N/A | N/A | 439073 | 439092 | GCTTTGATATTTTAGTGTCT | 6 | 553 |
| 994818 | N/A | N/A | 440092 | 440111 | TGAGCTGTATTATTATGCCA | 68 | 554 |
| 994826 | N/A | N/A | 441272 | 441291 | TCCAGATATGAGTTCTCTCT | 28 | 555 |
| 994834 | N/A | N/A | 442868 | 442887 | GTTCAGACTCAGATCTCTTC | 27 | 556 |
| 994842 | N/A | N/A | 444247 | 444266 | ATAGTCTTTAATTTTTTTCT | 88 | 557 |
| 994850 | N/A | N/A | 445319 | 445338 | GTGGAAGTGTTTCAGGGTTG | 14 | 558 |
| 994858 | N/A | N/A | 445807 | 445826 | TGTTGTTTAAATATGTCTCC | 23 | 559 |

TABLE 8-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994866 | N/A | N/A | 446198 | 446217 | GTGTGGTTATAAGAGATCTG | 27 | 560 |
| 994874 | N/A | N/A | 447042 | 447061 | CAGTGCTTTCTCCAGGGTGT | 3 | 561 |
| 994882 | N/A | N/A | 447995 | 448014 | TCCTCTTTATACCAGGGATC | 47 | 562 |
| 994890 | N/A | N/A | 448758 | 448777 | ATCTCCATAAATGGTATCCC | 37 | 563 |
| 994898 | N/A | N/A | 450475 | 450494 | GGAGAGAGAGAATATTTGAG | 22 | 564 |
| 994906 | N/A | N/A | 452112 | 452131 | TGCGGTTTGCTTATTCTTGC | 14 | 565 |
| 994914 | N/A | N/A | 452981 | 453000 | ACTTGAGTACATTCATATGG | 57 | 566 |
| 994922 | N/A | N/A | 453610 | 453629 | ATCTAGATTGAAGTTTGTAC | 94 | 567 |
| 994930 | N/A | N/A | 456945 | 456964 | TGAGGCTCTTCTCTTTGGGT | 35 | 568 |

TABLE 9

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994315 | 295 | 314 | 10706 | 10725 | ATTGCTGTACAAGGATGACA | 16 | 569 |
| 994323 | 433 | 452 | 106175 | 106194 | GCAGGCTGAAATCCACTCTT | 20 | 570 |
| 994331 | 690 | 709 | 277908 | 277927 | TGTTCTTTCTTCCTTTCACA | 29 | 571 |
| 994339 | 932 | 951 | 435651 | 435670 | CGGTGACTGTTTCACTGTCT | 70 | 572 |
| 994347 | 1068 | 1087 | 435787 | 435806 | CGGTGGTTGTCGCTGGGCAG | 24 | 573 |
| 994355 | 1879 | 1898 | 436598 | 436617 | AGCTTTCTTGGTGGCCTCCC | 91 | 574 |
| 994363 | 2213 | 2232 | 436932 | 436951 | GCTTCCCTAAATGCAGGCCA | 64 | 575 |
| 994371 | 2727 | 2746 | 437446 | 437465 | TCTTCCACCTTCTTTAGCTC | 96 | 576 |
| 994379* | 2812 | 2831 | 437531 | 437550 | GTCTTCAATCCTCTCTACGG | 3 | 577 |
| 994387 | 3127 | 3146 | 457380 | 457399 | CTCGGCATACCTGTGTCTGC | 58 | 578 |
| 994395 | 3313 | 3332 | 457566 | 457585 | GTCTTCTGACTTCTCCAGTT | 47 | 579 |
| 994403 | 3627 | 3646 | 457880 | 457899 | GCTCCTGCTGTGCCCTTCCT | 34 | 580 |
| 994411 | 4046 | 4065 | 458299 | 458318 | ATACAATTAAAAGTTGCTTT | 98 | 581 |
| 994419 | 4436 | 4455 | 458689 | 458708 | ACCCGAGTTGTCCATAGTCA | 12 | 582 |
| 994427 | 4701 | 4720 | 458954 | 458973 | CTTTCAATATCTTGCTCTTC | 25 | 583 |
| 994435 | 4856 | 4875 | 459109 | 459128 | CTTTTCTCTCAGTTTCTCTG | 23 | 584 |
| 994443 | 5219 | 5238 | 459472 | 459491 | GCTCACATATATAAATGTCT | 14 | 585 |
| 994451 | 5557 | 5576 | 459810 | 459829 | TTTTTTTTAATTTGTGAAA | 95 | 586 |
| 994459 | 5979 | 5998 | 460232 | 460251 | GTGTGTTTTCTGAGTCCAC | 3 | 587 |
| 994467 | 6040 | 6059 | 460293 | 460312 | ATCTTAGTGTTGGTTTAGTG | 14 | 588 |
| 994475 | 6231 | 6250 | 460484 | 460503 | TGAGCTTTAACTATATAGCA | 52 | 589 |

TABLE 9-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994483 | 6899 | 6918 | 461152 | 461171 | TGGCTGATCCTTGTAAGCTG | 64 | 590 |
| 994491 | 7080 | 7099 | 461333 | 461352 | TGTTGGTTTCTTATTAATAG | 12 | 591 |
| 994499 | 7151 | 7170 | 461404 | 461423 | TCTTAAGTTAAACATTCTAA | 49 | 592 |
| 994507 | 7839 | 7858 | 462092 | 462111 | ATAGGTTTCCTTAGTAGTCA | 17 | 593 |
| 994515 | 8068 | 8087 | 462321 | 462340 | TCTGCTGGCCCTGTTTTCAC | 23 | 594 |
| 994523 | 8356 | 8375 | 462609 | 462628 | TCCGGAGTAGAGGTGTGCAA | 68 | 595 |
| 994531 | 8510 | 8529 | 462763 | 462782 | GTGAGTGCTTCAAAATTTTG | 34 | 596 |
| 994539 | 8763 | 8782 | 463016 | 463035 | GTATAGTTTAAGAGCCTTTT | 8 | 597 |
| 994547 | 9121 | 9140 | 463374 | 463393 | CATTGAAATCATGTTTTTAC | 23 | 598 |
| 994555 | 9258 | 9277 | 463511 | 463530 | CCCACAGCTGTCCAGTTTCC | 62 | 599 |
| 994563 | 9700 | 9719 | 463953 | 463972 | ACTTGGTATTCTGGAGGACA | 6 | 600 |
| 994571 | 10096 | 10115 | 464349 | 464368 | GGGTAATGATCTGATATTAA | 5 | 601 |
| 994579 | 10239 | 10258 | 464492 | 464511 | ATGCACTTAAAATTTTCTTT | 10 | 602 |
| 994587 | 10368 | 10387 | 464621 | 464640 | TCTTCCATTTTTAATATTT | 22 | 603 |
| 994595 | 10611 | 10630 | 464864 | 464883 | TGGCACTGTTATTTTATTAG | 41 | 604 |
| 994603 | N/A | N/A | 15303 | 15322 | TGCTCATTAAATAATTGCAG | 57 | 605 |
| 994611 | N/A | N/A | 28526 | 28545 | GTGTCACTAGAAGATGCCCA | 39 | 606 |
| 994619 | N/A | N/A | 41522 | 41541 | GTGCTCACTAATAATAGTCT | 21 | 607 |
| 994627 | N/A | N/A | 71054 | 71073 | TCTCCTCTACTTAAGCTCAG | 42 | 608 |
| 994635 | N/A | N/A | 87298 | 87317 | GTTTCCTATCCTGATTCCCA | 43 | 609 |
| 994643 | N/A | N/A | 106499 | 106518 | GTTTGTGTGTTTAGTTGTTT | 10 | 610 |
| 994651 | N/A | N/A | 127663 | 127682 | GTGACCACTCTCCTCCTCCC | 55 | 611 |
| 994659 | N/A | N/A | 148376 149487 | 148395 149506 | AAGGTTTTCTCTTAAATATT | 54 | 612 |
| 994667 | N/A | N/A | 148746 149857 | 148765 149876 | TCCGAAGCTGCTATATGTCA | 51 | 613 |
| 994675 | N/A | N/A | 155513 | 155532 | GTGTGACACTATTATTCTTT | 27 | 614 |
| 994683 | N/A | N/A | 169801 | 169820 | CGACCTTTAAAATTTTTCA | 63 | 615 |
| 994691 | N/A | N/A | 180049 | 180068 | ATTTGTTTACTTCTATATTG | 65 | 616 |
| 994699 | N/A | N/A | 198910 | 198929 | GCTTCTTTAAATCTTAGCTC | 72 | 617 |
| 994707 | N/A | N/A | 218665 | 218684 | GTTTGAGTCCAGTGACTTCT | 44 | 618 |
| 994715 | N/A | N/A | 244999 | 245018 | TCTTGAGTTTATCTTTTCTT | 36 | 619 |
| 994723 | N/A | N/A | 269836 269865 269894 | 269855 269884 269913 | CTCCAGTGCAGGGCTGGACT | 86 | 620 |
| 994731 | N/A | N/A | 284231 | 284250 | GTTTGGGTTTTTCTGTACAA | 2 | 621 |
| 994739 | N/A | N/A | 305998 | 306017 | TGGTAGGTATATAGATGTCC | 3 | 622 |
| 994747 | N/A | N/A | 322370 323632 | 322389 323651 | ATCCCAATAAAAACATTCAG | 61 | 623 |

TABLE 9-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994755 | N/A | N/A | 331619 | 331638 | TGTTCCATAGCTCATTTGCA | 8 | 624 |
| 994763 | N/A | N/A | 353740 | 353759 | TGCTGTGTACTTAATTGACA | 41 | 625 |
| 994771 | N/A | N/A | 369407 | 369426 | TCTTGTCTAGTTTTCTGCAG | 54 | 626 |
| 994779 | N/A | N/A | 384151 | 384170 | GTCATTTTTGAACATATCCT | 11 | 627 |
| 994787 | N/A | N/A | 404260 | 404279 | GTCTGTGTACCTCATTCTTT | 13 | 628 |
| 994795 | N/A | N/A | 420137 | 420156 | GTGTGGGTGGCTGTGTCCTG | 70 | 629 |
| 994803 | N/A | N/A | 437851 | 437870 | TGGTGAGTTTCTGGATTGTC | 6 | 630 |
| 994811 | N/A | N/A | 439088 | 439107 | CTTTTATTTTCTGATGCTTT | 7 | 631 |
| 994819 | N/A | N/A | 440165 | 440184 | GTAGTTCATTTCTTTCTCC | 6 | 632 |
| 994827 | N/A | N/A | 441275 | 441294 | AAGTCCAGATATGAGTTCTC | 25 | 633 |
| 994835 | N/A | N/A | 442870 | 442889 | ATGTTCAGACTCAGATCTCT | 26 | 634 |
| 994843 | N/A | N/A | 444248 | 444267 | AATAGTCTTTAATTTTTTC | 88 | 635 |
| 994851 | N/A | N/A | 445325 | 445344 | TCCTTGGTGGAAGTGTTTCA | 57 | 636 |
| 994859 | N/A | N/A | 445808 | 445827 | CTGTTGTTTAAATATGTCTC | 15 | 637 |
| 994867 | N/A | N/A | 446255 | 446274 | TCCTCCACTCTTTCCCTCCC | 98 | 638 |
| 994875 | N/A | N/A | 447189 | 447208 | GTTTGCCTTCTGTATGGAAA | 12 | 639 |
| 994883 | N/A | N/A | 448112 | 448131 | TGGAGCCTTGCTATGTTGGC | 59 | 640 |
| 994891 | N/A | N/A | 448954 | 448973 | TGGTTAAGACCTAGTTTCTT | 42 | 641 |
| 994899 | N/A | N/A | 451089 | 451108 | ATTTCTTGAGATGGATTCTC | 24 | 642 |
| 994907 | N/A | N/A | 452123 | 452142 | TCTACCAGAGTTGCGGTTTG | 53 | 643 |
| 994915 | N/A | N/A | 453089 | 453108 | CTTCATCTTCTTTGTTTCCT | 36 | 644 |
| 994923 | N/A | N/A | 455414 | 455433 | CATTCTTTTGAGTTGTGACC | 31 | 645 |
| 994931 | N/A | N/A | 457057 | 457076 | GTTTGATTTATGCACACAC | 63 | 646 |

Example 2: Effect of 5-10-5 MOE Gapmer Modified Oligonucleotides on Human ATXN1 RNA In Vitro, Single Dose Modified oligonucleotides complementary to human ATXN1 nucleic acid were designed and tested for their single dose effects on ATXN1 mRNA in vitro. The modified oligonucleotides were tested in a series of experiments that had similar culture conditions.

The modified oligonucleotides in the tables below are 5-10-5 MOE gapmers with mixed internucleoside linkages. The gapmers are 20 nucleosides in length, wherein the central gap segment consists of ten 2'-β-D-deoxynucleosides and the 3' and 5' wings each consist of five 2'-MOE modified nucleosides. The motif for the gapmers is (from 5' to 3'): eeeeedddddddddeeeee; wherein "d" represents a 2'-β-D-deoxyribosyl sugar, and 'e' represents a 2'-MOE modified ribosyl sugar. The internucleoside linkage motif for the gapmers is (from 5' to 3'): sooossssssssssooss; wherein 'o' represents a phosphodiester internucleoside linkage and 's' represents a phosphorothioate internucleoside linkage. Each cytosine residue is a 5-methyl cytosine.

"Start site" indicates the 5'-most nucleoside to which the modified oligonucleotide is complementary in the human gene sequence. "Stop site" indicates the 3'-most nucleoside to which the modified oligonucleotide is complementary in the human gene sequence. Each modified oligonucleotide listed in the Tables below is 100% complementary to SEQ ID NO: 1, SEQ ID NO: 2, or SEQ ID NO: 3 (GENBANK Accession No. NM_001128164.1). 'N/A' indicates that the modified oligonucleotide is not 100% complementary to that particular gene sequence.

Cultured A-431 cells were treated with modified oligonucleotide at a concentration of 4,000 nM by free uptake at a density of 10,000 cells per well for a treatment period of 48 hours. At the end of their treatment period, total RNA was isolated from the cells and ATXN1 RNA levels were measured by quantitative real-time RTPCR. ATXN1 RNA levels were measured by Human ATXN1 primer probe set RTS37575 (forward sequence GTATAGGCTGAGGC-TACCTGT, designated herein as SEQ ID NO: 14; reverse sequence GATCCAGGCTCTTCATGAGG, designated herein as SEQ ID NO: 15; probe sequence ACAGCAGCTCTGGATGAACATTCACT, designated herein as SEQ ID NO: 16). ATXN1 RNA levels were normalized to total RNA content, as measured by RIBOGREEN® fluorescent RNA assay. Results are presented in the tables below as percent ATXN1 RNA levels relative to untreated control cells (% Control). The Compound No. marked with an asterisk (*) indicates that the modified oligonucleotide is complementary to the amplicon region of the primer probe set. Additional assays may be used to measure the potency and efficacy of the modified oligonucleotides complementary to the amplicon region.

TABLE 10

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 4 | 138 |
| 1040079 | 468 | 487 | N/A | N/A | AGACCAAAAACCATTTGTGT | 9 | 647 |
| 1040111 | 2755 | 2774 | 437474 | 437493 | ACTCTGGATGAAATCTTCTG | 71 | 648 |
| 1040143 | 3244 | 3263 | 457497 | 457516 | GCTGGGTTCTATTTTGGTGA | 46 | 649 |
| 1040175 | 4029 | 4048 | 458282 | 458301 | TTTTATTGTAAAATATGTTG | 90 | 650 |
| 1040207 | 4510 | 4529 | 458763 | 458782 | GATAGTAATATATGCTCATC | 9 | 651 |
| 1040239 | 4767 | 4786 | 459020 | 459039 | TTGGTGGTCATTTATTGTCA | 8 | 652 |
| 1040271 | 5224 | 5243 | 459477 | 459496 | ATCTTGCTCACATATATAAA | 33 | 653 |
| 1040303 | 5589 | 5608 | 459842 | 459861 | CTAGACAGCCAAAATGTGGG | 29 | 654 |
| 1040335 | 6017 | 6036 | 460270 | 460289 | CCAGTCAATTCAATACTCGA | 14 | 655 |
| 1040367 | 6475 | 6494 | 460728 | 460747 | CTCCACATTCACTATTCCGT | 13 | 656 |
| 1040399 | 7152 | 7171 | 461405 | 461424 | TTCTTAAGTTAAACATTCTA | 75 | 657 |
| 1040431 | 7622 | 7641 | 461875 | 461894 | GGAGTAATCCACAAGATGCA | 48 | 658 |
| 1040463 | 8111 | 8130 | 462364 | 462383 | TCCTTTCACATCACCACCGA | 42 | 659 |
| 1040495 | 8375 | 8394 | 462628 | 462647 | ATGTAAAAGAAATCTCAGCT | 42 | 660 |
| 1040527 | 8696 | 8715 | 462949 | 462968 | ACATGACAAATTTCTATATA | 79 | 661 |
| 1040559 | 9109 | 9128 | 463362 | 463381 | GTTTTTACTCCCCCCATTTA | 106 | 662 |
| 1040591 | 9441 | 9460 | 463694 | 463713 | TGCACTTAATTTTAATACAG | 24 | 663 |
| 1040623 | 9885 | 9904 | 464138 | 464157 | GGGCAGTATTCACAGAACTG | 27 | 664 |
| 1040655 | 10254 | 10273 | 464507 | 464526 | TCTTAACTATTATGTATGCA | 18 | 665 |
| 1040687 | 10527 | 10546 | 464780 | 464799 | TCAAATTTTGAATCAAACAT | 88 | 666 |
| 1040719 | N/A | N/A | 17960 | 17979 | TGAGTGCACATTTAATCTTT | 11 | 667 |
| 1040751 | N/A | N/A | 31937 | 31956 | TTGTCATATTTTTATAGCAT | 76 | 668 |
| 1040783 | N/A | N/A | 51100 | 51119 | TGTTCATTCCCTTAGTAACT | 21 | 669 |
| 1040815 | N/A | N/A | 77282 | 77301 | GGCAAGATCTTTTAAAGTCC | 18 | 670 |
| 1040847 | N/A | N/A | 94809 | 94828 | AGACTGTTTCTTTACCACAT | 14 | 671 |
| 1040879 | N/A | N/A | 118132 | 118151 | TCCACCAGTATTTATGGAGT | 119 | 672 |
| 1040911 | N/A | N/A | 151437 | 151456 | CTTTAGTATTTTTATCATTA | 40 | 673 |
| 1040943 | N/A | N/A | 179378 | 179397 | AACAGTACAATTTACTTGAC | 56 | 674 |
| 1040975 | N/A | N/A | 195960 | 195979 | CCTTTAAAAACCAACACAGT | 84 | 675 |
| 1041007 | N/A | N/A | 216607 | 216626 | TCTTGTCATTTTTAACATCC | 28 | 676 |
| 1041039 | N/A | N/A | 237165 | 237184 | ACTCAATTTTAAAGACTCGG | 38 | 677 |
| 1041071 | N/A | N/A | 258705 | 258724 | ATGTGTTGAATTTAACCAGC | 22 | 678 |

TABLE 10-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041103 | N/A | N/A | 276428 | 276447 | CTCATTAATTAAATCATTCG | 105 | 679 |
| 1041135 | N/A | N/A | 295010 | 295029 | CACCTAAAAATACAGGAAGT | 76 | 680 |
| 1041167 | N/A | N/A | 324809 | 324828 | CCAAGAATTTAAAAGGACA | 42 | 681 |
| 1041199 | N/A | N/A | 345760 | 345779 | TGTCTCAAACTATTCCCATT | 26 | 682 |
| 1041231 | N/A | N/A | 371655 | 371674 | TTAACAATCTTTTAGACCTG | 24 | 683 |
| 1041263 | N/A | N/A | 393703 | 393722 | GACATATTTCAAAAATGCAA | 68 | 684 |
| 1041295 | N/A | N/A | 426181 | 426200 | AACTTGTTTCAAAGTGAGAG | 88 | 685 |
| 1041327 | N/A | N/A | 437896 | 437915 | TCAGGGTTCCTCATCTTAAT | 24 | 686 |
| 1041359 | N/A | N/A | 438301 | 438320 | AGAGAGTATAAAAATTATCT | 72 | 687 |
| 1041391 | N/A | N/A | 438910 | 438929 | GCAGCCTCCTATATTGGTCC | 40 | 688 |
| 1041423 | N/A | N/A | 439178 | 439197 | CCAGTGACTCATCTTGGCTA | 48 | 689 |
| 1041455 | N/A | N/A | 439863 | 439882 | TGGTCCTTTCCTCACTTGGG | 27 | 690 |
| 1041487 | N/A | N/A | 440220 | 440239 | CATGTTTATTTTCCATGTGT | 8 | 691 |
| 1041519 | N/A | N/A | 440788 | 440807 | ACACACCTAGATCTTCCTCC | 49 | 692 |
| 1041551 | N/A | N/A | 441387 | 441406 | CAGCAGTGCCTAACCAGTTG | 43 | 693 |
| 1041583 | N/A | N/A | 441652 | 441671 | TGCCAGAGACCCAAATCCGC | 64 | 694 |
| 1041615 | N/A | N/A | 442276 | 442295 | TCATCCCCAAACTAAACACC | 100 | 695 |
| 1041647 | N/A | N/A | 442821 | 442840 | GCTAACCTACTTCCTACCCA | 59 | 696 |
| 1041679 | N/A | N/A | 443177 | 443196 | CATGACATCATTTAGCCTTA | 12 | 697 |
| 1041711 | N/A | N/A | 443557 | 443576 | GGCCCTAATAACACAGAGCC | 113 | 698 |
| 1041743 | N/A | N/A | 444006 | 444025 | GCGGCACAAATCCAGGGCTG | 71 | 699 |
| 1041775 | N/A | N/A | 444407 | 444426 | GTAGTATAAACTATGGACTT | 26 | 700 |
| 1041807 | N/A | N/A | 445306 | 445325 | AGGGTTGTTCAGTAAACCCA | 134 | 701 |
| 1041839 | N/A | N/A | 445658 | 445677 | GCTAGGTTTCAGTAAGTATG | 9 | 702 |
| 1041871 | N/A | N/A | 445920 | 445939 | ACACGCATATTTATGCTGTT | 64 | 703 |
| 1041903 | N/A | N/A | 446128 | 446147 | ACCTCCAACTCCCATTTTGG | 54 | 704 |
| 1041935 | N/A | N/A | 446724 | 446743 | GTAAATATATCCTGTTTCAA | 59 | 705 |
| 1041967 | N/A | N/A | 446975 | 446994 | TCACCTTGTCAGATGCTGAG | 45 | 706 |
| 1041999 | N/A | N/A | 447909 | 447928 | GGTGAGCAACCATTCCAGAC | 74 | 707 |
| 1042031 | N/A | N/A | 448558 | 448577 | CTCGGTCACCACATGCAAGC | 102 | 708 |
| 1042063 | N/A | N/A | 448821 | 448840 | GACCTAAAACACACCAGACC | 78 | 709 |
| 1042095 | N/A | N/A | 449388 | 449407 | ATAGCTTCAAAATATTGTTA | 31 | 710 |
| 1042127 | N/A | N/A | 449700 | 449719 | ATCTTTATTTTATAATTAGG | 87 | 711 |
| 1042159 | N/A | N/A | 449981 | 450000 | GATGCCACGACCAGATATCA | 73 | 712 |
| 1042191 | N/A | N/A | 450575 | 450594 | ACCAAACTCCAAATCTCCAA | 38 | 713 |
| 1042223 | N/A | N/A | 451243 | 451262 | TCAACCTTCTTGAACCCTCA | 62 | 714 |

TABLE 10-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
| --- | --- | --- | --- | --- | --- | --- | --- |
| 1042255 | N/A | N/A | 451690 | 451709 | TCATTATTTCCGCATCTCAA | 13 | 715 |
| 1042287 | N/A | N/A | 451970 | 451989 | CCGGACACCTACCCATGGAG | 82 | 716 |
| 1042319 | N/A | N/A | 452312 | 452331 | CACTGTATTCTAAGTAGGAG | 81 | 717 |
| 1042351 | N/A | N/A | 452637 | 452656 | GCCTCCTGACCTCTACCCTT | 56 | 718 |
| 1042383 | N/A | N/A | 453119 | 453138 | AGTAGATTTCCACAGATTGT | 26 | 719 |
| 1042415 | N/A | N/A | 453901 | 453920 | AGCCTCTAGAACAAAATACA | 97 | 720 |
| 1042447 | N/A | N/A | 455088 | 455107 | AGCTTGAGAATTTTGATAGG | 22 | 721 |
| 1042479 | N/A | N/A | 455365 | 455384 | GAACCACAAGCCAACAGGCC | 89 | 722 |
| 1042511 | N/A | N/A | 456665 | 456684 | ACTGTGAGTTCCAAGAAGCA | 49 | 723 |

TABLE 11

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
| --- | --- | --- | --- | --- | --- | --- | --- |
| 994605 | N/A | N/A | 17726 | 17745 | GTCACCTTTTCTATTTGCAC | 3 | 138 |
| 1040080* | 824 | 843 | 435543 | 435562 | TGGGTACAATCCGCCAACAG | 32 | 724 |
| 1040112 | 2813 | 2832 | 437532 | 437551 | TGTCTTCAATCCTCTCTACG | 65 | 725 |
| 1040144 | 3334 | 3353 | 457587 | 457606 | AGGAAGAGTCAAAGGTGGTT | 41 | 726 |
| 1040176 | 4034 | 4053 | 458287 | 458306 | GTTGCTTTTATTGTAAAATA | 29 | 727 |
| 1040208 | 4512 | 4531 | 458765 | 458784 | AAGATAGTAATATATGCTCA | 11 | 728 |
| 1040240 | 4802 | 4821 | 459055 | 459074 | CATCAAAGTGAAAAGTGCCT | 48 | 729 |
| 1040272 | 5278 | 5297 | 459531 | 459550 | CCATTCTGAAAATAACATTA | 15 | 730 |
| 1040304 | 5614 | 5633 | 459867 | 459886 | GGTGAACCCTAAATGTAAAT | 40 | 731 |
| 1040336 | 6018 | 6037 | 460271 | 460290 | TCCAGTCAATTCAATACTCG | 26 | 732 |
| 1040368 | 6478 | 6497 | 460731 | 460750 | ACACTCCACATTCACTATTC | 55 | 733 |
| 1040400 | 7162 | 7181 | 461415 | 461434 | ACTGAAATAATTCTTAAGTT | 108 | 734 |
| 1040432 | 7653 | 7672 | 461906 | 461925 | AGCATTATATTGCAATCTAT | 31 | 735 |
| 1040464 | 8113 | 8132 | 462366 | 462385 | TCTCCTTTCACATCACCACC | 27 | 736 |
| 1040496 | 8385 | 8404 | 462638 | 462657 | GAGGTCATCTATGTAAAAGA | 15 | 737 |
| 1040528 | 8697 | 8716 | 462950 | 462969 | GACATGACAAATTCTATAT | 12 | 738 |
| 1040560 | 9114 | 9133 | 463367 | 463386 | ATCATGTTTTTACTCCCCCC | 48 | 739 |
| 1040592 | 9454 | 9473 | 463707 | 463726 | CCTATTGGCCAAATGCACTT | 46 | 740 |
| 1040624 | 9970 | 9989 | 464223 | 464242 | TCTTGAAACCTCCTTTCGGC | 74 | 741 |
| 1040656 | 10255 | 10274 | 464508 | 464527 | CTCTTAACTATTATGTATGC | 25 | 742 |
| 1040688 | 10529 | 10548 | 464782 | 464801 | GTTCAAATTTTGAATCAAAC | 39 | 743 |
| 1040720 | N/A | N/A | 18197 | 18216 | CCCAAATTTCAAGGTCCTT | 6 | 744 |

TABLE 11-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040752 | N/A | N/A | 32181 | 32200 | GTGGTCAAAGAATCTGTTTC | 10 | 745 |
| 1040784 | N/A | N/A | 51766 | 51785 | TAGAAACTAATTTATTAGTG | 119 | 746 |
| 1040816 | N/A | N/A | 77793 | 77812 | ACACAGATTATTTATAGTCA | 13 | 747 |
| 1040848 | N/A | N/A | 96129 | 96148 | CACTTTCTAGATTATTCTTA | 84 | 748 |
| 1040880 | N/A | N/A | 118292 | 118311 | ACTCTCTACCTTTAAGATTT | 28 | 749 |
| 1040912 | N/A | N/A | 153619 | 153638 | CATCTATTTATTTACCTTCT | 30 | 750 |
| 1040944 | N/A | N/A | 179493 | 179512 | GAACTTAAAATTCCCTAGGA | 111 | 751 |
| 1040976 | N/A | N/A | 195968 | 195987 | TCTTTTAACCTTTAAAAACC | 53 | 752 |
| 1041008 | N/A | N/A | 216637 | 216656 | ACCTGCTTTCAAAAGTCAAA | 72 | 753 |
| 1041040 | N/A | N/A | 238066 | 238085 | CAAGTAATACAAATCCACAG | 65 | 754 |
| 1041072 | N/A | N/A | 259575 | 259594 | CAGGACTTATTTTATATATG | 32 | 755 |
| 1041104 | N/A | N/A | 276769 | 276788 | CTTCCCAAATACATCATCGA | 101 | 756 |
| 1041136 | N/A | N/A | 295238 | 295257 | CATTTAAAAACTGTACATGG | 20 | 757 |
| 1041168 | N/A | N/A | 324921 | 324940 | ATCTAAATTTAAACTGCACA | 31 | 758 |
| 1041200 | N/A | N/A | 347770 | 347789 | TGGTCAATAATTTATATGGC | 2 | 759 |
| 1041232 | N/A | N/A | 372753 | 372772 | AACTATTATATTTATAGATT | 108 | 760 |
| 1041264 | N/A | N/A | 395038 | 395057 | AGCTGTAAAATATATCCCTG | 8 | 761 |
| 1041296 | N/A | N/A | 427897 | 427916 | AACCTTACTTAAATATCTCA | 62 | 762 |
| 1041328 | N/A | N/A | 437897 | 437916 | ATCAGGGTTCCTCATCTTAA | 11 | 763 |
| 1041360 | N/A | N/A | 438322 | 438341 | GTGCCCTTTCCTCTTGGGAT | 58 | 764 |
| 1041392 | N/A | N/A | 438914 | 438933 | CCCAGCAGCCTCCTATATTG | 91 | 765 |
| 1041424 | N/A | N/A | 439182 | 439201 | ACTTCCAGTGACTCATCTTG | 34 | 766 |
| 1041456 | N/A | N/A | 439866 | 439885 | ATTTGGTCCTTTCCTCACTT | 28 | 767 |
| 1041488 | N/A | N/A | 440222 | 440241 | CTCATGTTTATTTTCCATGT | 31 | 768 |
| 1041520 | N/A | N/A | 440796 | 440815 | AGGGAAAAACACACCTAGAT | 39 | 769 |
| 1041552 | N/A | N/A | 441389 | 441408 | GTCAGCAGTGCCTAACCAGT | 41 | 770 |
| 1041584 | N/A | N/A | 441726 | 441745 | ACAGAAAAACAAAACTCATT | 105 | 771 |
| 1041616 | N/A | N/A | 442285 | 442304 | CCTTAAAAATCATCCCCAAA | 99 | 772 |
| 1041648 | N/A | N/A | 442823 | 442842 | CAGCTAACCTACTTCCTACC | 90 | 773 |
| 1041680 | N/A | N/A | 443212 | 443231 | TCAGAAATACAGATTGATAT | 44 | 774 |
| 1041712 | N/A | N/A | 443559 | 443578 | ACGGCCCTAATAACACAGAG | 94 | 775 |
| 1041744 | N/A | N/A | 444009 | 444028 | ACTGCGGCACAAATCCAGGG | 32 | 776 |
| 1041776 | N/A | N/A | 444408 | 444427 | TGTAGTATAAACTATGGACT | 23 | 777 |
| 1041808 | N/A | N/A | 445316 | 445335 | GAAGTGTTTCAGGGTTGTTC | 8 | 778 |
| 1041840 | N/A | N/A | 445659 | 445678 | AGCTAGGTTTCAGTAAGTAT | 7 | 779 |
| 1041872 | N/A | N/A | 445921 | 445940 | TACACGCATATTTATGCTGT | 98 | 780 |

TABLE 11-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041904 | N/A | N/A | 446135 | 446154 | AACTGTCACCTCCAACTCCC | 57 | 781 |
| 1041936 | N/A | N/A | 446727 | 446746 | CCAGTAAATATATCCTGTTT | 26 | 782 |
| 1041968 | N/A | N/A | 446985 | 447004 | CATAGCCACCTCACCTTGTC | 72 | 783 |
| 1042000 | N/A | N/A | 447963 | 447982 | GCAACAGACCAGTAGCAGTC | 79 | 784 |
| 1042032 | N/A | N/A | 448600 | 448619 | TACCTCCACCACCTTTGTCC | 63 | 785 |
| 1042064 | N/A | N/A | 448823 | 448842 | GTGACCTAAAACACACCAGA | 37 | 786 |
| 1042096 | N/A | N/A | 449389 | 449408 | GATAGCTTCAAAATATTGTT | 20 | 787 |
| 1042128 | N/A | N/A | 449708 | 449727 | GCAAATCTATCTTTATTTTA | 79 | 788 |
| 1042160 | N/A | N/A | 449991 | 450010 | CCTGCGAAAAGATGCCACGA | 117 | 789 |
| 1042192 | N/A | N/A | 450674 | 450693 | AAGTTCAGTTACAGAGGTGC | 19 | 790 |
| 1042224 | N/A | N/A | 451247 | 451266 | GTTCTCAACCTTCTTGAACC | 110 | 791 |
| 1042256 | N/A | N/A | 451693 | 451712 | CTTTCATTATTTCCGCATCT | 14 | 792 |
| 1042288 | N/A | N/A | 451971 | 451990 | GCCGGACACCTACCCATGGA | 132 | 793 |
| 1042320 | N/A | N/A | 452314 | 452333 | CCCACTGTATTCTAAGTAGG | 82 | 794 |
| 1042352 | N/A | N/A | 452646 | 452665 | TTTTTCTGTGCCTCCTGACC | 59 | 795 |
| 1042384 | N/A | N/A | 453143 | 453162 | AAGTACCAAAAAAACTTTAA | 77 | 796 |
| 1042416 | N/A | N/A | 454243 | 454262 | AGCCTCTAGAACAGGCTGGG | 131 | 797 |
| 1042448 | N/A | N/A | 455090 | 455109 | ACAGCTTGAGAATTTTGATA | 21 | 798 |
| 1042480 | N/A | N/A | 455370 | 455389 | ACAGTGAACCACAAGCCAAC | 107 | 799 |
| 1042512 | N/A | N/A | 456692 | 456711 | ACAGGACTAAACATGGATCA | 39 | 800 |

TABLE 12

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 1 | 138 |
| 1040081* | 856 | 875 | 435575 | 435594 | ATCCAGGCTCTTCATGAGGA | 5 | 801 |
| 1040113 | 2819 | 2838 | 437538 | 437557 | TATGGCTGTCTTCAATCCTC | 53 | 802 |
| 1040145 | 3369 | 3388 | 457622 | 457641 | CAAATCTTAACCTCCTGAGG | 48 | 803 |
| 1040177 | 4047 | 4066 | 458300 | 458319 | TATACAATTAAAAGTTGCTT | 110 | 804 |
| 1040209 | 4531 | 4550 | 458784 | 458803 | CAGTATTTTAAATGCTTAA | 35 | 805 |
| 1040241 | 4815 | 4834 | 459068 | 459087 | ACTGATTCTCAGACATCAAA | 40 | 806 |
| 1040273 | 5279 | 5298 | 459532 | 459551 | GCCATTCTGAAAATAACATT | 9 | 807 |
| 1040305 | 5616 | 5635 | 459869 | 459888 | CTGGTGAACCCTAAATGTAA | 43 | 808 |
| 1040337 | 6019 | 6038 | 460272 | 460291 | ATCCAGTCAATTCAATACTC | 10 | 809 |
| 1040369 | 6480 | 6499 | 460733 | 460752 | CCACACTCCACATTCACTAT | 35 | 810 |

TABLE 12-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040401 | 7190 | 7209 | 461443 | 461462 | CCCCTCTGCCCCAGTGTGGC | 96 | 811 |
| 1040433 | 7656 | 7675 | 461909 | 461928 | TGCAGCATTATATTGCAATC | 74 | 812 |
| 1040465 | 8114 | 8133 | 462367 | 462386 | CTCTCCTTTCACATCACCAC | 30 | 813 |
| 1040497 | 8417 | 8436 | 462670 | 462689 | TCCTATCATCAGTAAGGTAA | 92 | 814 |
| 1040529 | 8711 | 8730 | 462964 | 462983 | AATCTGATCATTTAGACATG | 42 | 815 |
| 1040561 | 9115 | 9134 | 463368 | 463387 | AATCATGTTTTACTCCCCC | 76 | 816 |
| 1040593 | 9464 | 9483 | 463717 | 463736 | ATAGATACTACCTATTGGCC | 39 | 817 |
| 1040625 | 9971 | 9990 | 464224 | 464243 | ATCTTGAAACCTCCTTTCGG | 55 | 818 |
| 1040657 | 10257 | 10276 | 464510 | 464529 | AGCTCTTAACTATTATGTAT | 16 | 819 |
| 1040689 | 10559 | 10578 | 464812 | 464831 | GTATACAGACAATTTATTTA | 83 | 820 |
| 1040721 | N/A | N/A | 18359 | 18378 | ACATGGTATTTTATCAGTC | 3 | 821 |
| 1040753 | N/A | N/A | 33291 | 33310 | CCTAACAAAATTTCCCTTCA | 73 | 822 |
| 1040785 | N/A | N/A | 53624 | 53643 | GTGAATTTTCCTTAAATTTC | 23 | 823 |
| 1040817 | N/A | N/A | 77899 | 77918 | TGCAAATTCTAAAAATTACT | 101 | 824 |
| 1040849 | N/A | N/A | 96635 | 96654 | TTCTTGTTTCAAAGTGAGGA | 121 | 825 |
| 1040881 | N/A | N/A | 118343 | 118362 | GACCTCATCCATTATAATAT | 52 | 826 |
| 1040913 | N/A | N/A | 153709 | 153728 | CCAACCAACCAAAAACTCAC | 101 | 827 |
| 1040945 | N/A | N/A | 179793 | 179812 | CATAGTTATATTTAATCATG | 64 | 828 |
| 1040977 | N/A | N/A | 196970 | 196989 | ATGCCTCACCTTTAAATAGT | 82 | 829 |
| 1041009 | N/A | N/A | 217125 | 217144 | GACAAGTTTATTTATTTTTC | 25 | 830 |
| 1041041 | N/A | N/A | 239500 | 239519 | AACTGATTTCAAAGTCAGAC | 131 | 831 |
| 1041073 | N/A | N/A | 260025 | 260044 | ACTGAAACTTTTTAACATAC | 37 | 832 |
| 1041105 | N/A | N/A | 278198 | 278217 | CAGCAAATACAAACAGGACC | 3 | 833 |
| 1041137 | N/A | N/A | 295336 | 295355 | ACACAGTTACAAATCAATGC | 1 | 834 |
| 1041169 | N/A | N/A | 324924 | 324943 | TGGATCTAAATTTAAACTGC | 6 | 835 |
| 1041201 | N/A | N/A | 348183 | 348202 | ATGCTCAAACCTCATTCATT | 23 | 836 |
| 1041233 | N/A | N/A | 373954 | 373973 | TACTCCTTATTTTAAATATA | 114 | 837 |
| 1041265 | N/A | N/A | 395428 | 395447 | AAGGTTCTATTTTATATGCC | 24 | 838 |
| 1041297 | N/A | N/A | 428019 | 428038 | AGTGTTAGAGAATACTTTTC | 33 | 839 |
| 1041329 | N/A | N/A | 437898 | 437917 | AATCAGGGTTCCTCATCTTA | 26 | 840 |
| 1041361 | N/A | N/A | 438362 | 438381 | TGCCCCCACTTTACGGTGT | 98 | 841 |
| 1041393 | N/A | N/A | 438931 | 438950 | CAGTCCAGAGCCCACTCCCC | 96 | 842 |
| 1041425 | N/A | N/A | 439188 | 439207 | AACCATACTTCCAGTGACTC | 10 | 843 |
| 1041457 | N/A | N/A | 439897 | 439916 | CCAGTCATTCACGAGTGGTT | 60 | 844 |
| 1041489 | N/A | N/A | 440232 | 440251 | TGACTCTTCACTCATGTTTA | 67 | 845 |
| 1041521 | N/A | N/A | 440798 | 440817 | GTAGGGAAAAACACACCTAG | 87 | 846 |

TABLE 12-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041553 | N/A | N/A | 441417 | 441436 | CATTTCTGAATTTCTCTGTG | 15 | 847 |
| 1041585 | N/A | N/A | 441728 | 441747 | CCACAGAAAAACAAAACTCA | 100 | 848 |
| 1041617 | N/A | N/A | 442286 | 442305 | CCCTTAAAAATCATCCCCAA | 103 | 849 |
| 1041649 | N/A | N/A | 442824 | 442843 | GCAGCTAACCTACTTCCTAC | 24 | 850 |
| 1041681 | N/A | N/A | 443215 | 443234 | TACTCAGAAATACAGATTGA | 62 | 851 |
| 1041713 | N/A | N/A | 443563 | 443582 | ACAGACGGCCCTAATAACAC | 106 | 852 |
| 1041745 | N/A | N/A | 444022 | 444041 | TGTATTACCAACAACTGCGG | 37 | 853 |
| 1041777 | N/A | N/A | 444419 | 444438 | ACAGAGTGAACTGTAGTATA | 3 | 854 |
| 1041809 | N/A | N/A | 445337 | 445356 | AGCCTGACTCAGTCCTTGGT | 122 | 855 |
| 1041841 | N/A | N/A | 445672 | 445691 | GAATTCTCTCATAAGCTAGG | 51 | 856 |
| 1041873 | N/A | N/A | 445928 | 445947 | ATGCACATACACGCATATTT | 57 | 857 |
| 1041905 | N/A | N/A | 446161 | 446180 | CCATCCCCCTAAATCGACTC | 84 | 858 |
| 1041937 | N/A | N/A | 446729 | 446748 | ATCCAGTAAATATATCCTGT | 15 | 859 |
| 1041969 | N/A | N/A | 447005 | 447024 | GGCAGCTTTCTCAGCGGAGC | 65 | 860 |
| 1042001 | N/A | N/A | 447978 | 447997 | ATCCCCAACCCCCAGGCAAC | 110 | 861 |
| 1042033 | N/A | N/A | 448602 | 448621 | ACTACCTCCACCACCTTTGT | 57 | 862 |
| 1042065 | N/A | N/A | 448825 | 448844 | AAGTGACCTAAAACACACCA | 88 | 863 |
| 1042097 | N/A | N/A | 449390 | 449409 | TGATAGCTTCAAAATATTGT | 30 | 864 |
| 1042129 | N/A | N/A | 449710 | 449729 | TAGCAAATCTATCTTTATTT | 70 | 865 |
| 1042161 | N/A | N/A | 450005 | 450024 | AGGAGCTGTGTCACCCTGCG | 71 | 866 |
| 1042193 | N/A | N/A | 450685 | 450704 | CAGCCAAACCTAAGTTCAGT | 32 | 867 |
| 1042225 | N/A | N/A | 451248 | 451267 | AGTTCTCAACCTTCTTGAAC | 78 | 868 |
| 1042257 | N/A | N/A | 451698 | 451717 | AAAGCCTTTCATTATTTCCG | 9 | 869 |
| 1042289 | N/A | N/A | 452004 | 452023 | CCGGATAACTCCCTGTCTCC | 80 | 870 |
| 1042321 | N/A | N/A | 452315 | 452334 | ACCCACTGTATTCTAAGTAG | 23 | 871 |
| 1042353 | N/A | N/A | 452658 | 452677 | AACCCATTTTCTTTTTTCTG | 119 | 872 |
| 1042385 | N/A | N/A | 453188 | 453207 | GATTTATACACATTCAGAC | 58 | 873 |
| 1042417 | N/A | N/A | 454279 | 454298 | CATCTTGTAAACTAAACAGG | 58 | 874 |
| 1042449 | N/A | N/A | 455116 | 455135 | GCTTACAATAATTAAGAAGA | 60 | 875 |
| 1042481 | N/A | N/A | 455372 | 455391 | AGACAGTGAACCACAAGCCA | 95 | 876 |
| 1042513 | N/A | N/A | 456694 | 456713 | GGACAGGACTAAACATGGAT | 23 | 877 |

TABLE 13

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040082 | 896 | 915 | 435615 | 435634 | AGTCTGATAAACGGAAAGTC | 58 | 878 |
| 1040114 | 2839 | 2858 | 437558 | 437577 | TATCACGGCCACGCCCGGGC | 149 | 879 |
| 1040146 | 3372 | 3391 | 457625 | 457644 | ATGCAAATCTTAACCTCCTG | 12 | 880 |
| 1040178 | 4048 | 4067 | 458301 | 458320 | CTATACAATTAAAAGTTGCT | 111 | 881 |
| 1040210 | 4532 | 4551 | 458785 | 458804 | ACAGTATTTTAAATGCTTA | 52 | 882 |
| 1040242 | 4816 | 4835 | 459069 | 459088 | AACTGATTCTCAGACATCAA | 39 | 883 |
| 1040274 | 5306 | 5325 | 459559 | 459578 | GATTTGATTTTGAATAGAAA | 64 | 884 |
| 1040306 | 5617 | 5636 | 459870 | 459889 | CCTGGTGAACCCTAAATGTA | 66 | 885 |
| 1040338 | 6025 | 6044 | 460278 | 460297 | TAGTGGATCCAGTCAATTCA | 22 | 886 |
| 1040370 | 6483 | 6502 | 460736 | 460755 | TCTCCACACTCCACATTCAC | 87 | 887 |
| 1040402 | 7241 | 7260 | 461494 | 461513 | CACTTTAAAGATCTGAGGT | 51 | 888 |
| 1040434 | 7676 | 7695 | 461929 | 461948 | GCTACTGTTCATCTTGAACA | 76 | 889 |
| 1040466 | 8123 | 8142 | 462376 | 462395 | AGTGTAATTCTCTCCTTTCA | 17 | 890 |
| 1040498 | 8426 | 8445 | 462679 | 462698 | AAGAAAAGATCCTATCATCA | 76 | 891 |
| 1040530 | 8716 | 8735 | 462969 | 462988 | ATACAAATCTGATCATTTAG | 60 | 892 |
| 1040562 | 9116 | 9135 | 463369 | 463388 | AAATCATGTTTTTACTCCCC | 81 | 893 |
| 1040594 | 9466 | 9485 | 463719 | 463738 | GTATAGATACTACCTATTGG | 27 | 894 |
| 1040626 | 9991 | 10010 | 464244 | 464263 | CCACAAATACTGACAGGACT | 18 | 895 |
| 1040658 | 10258 | 10277 | 464511 | 464530 | AAGCTCTTAACTATTATGTA | 28 | 896 |
| 1040690 | 10561 | 10580 | 464814 | 464833 | TGGTATACAGACAATTTATT | 58 | 897 |
| 1040722 | N/A | N/A | 18895 | 18914 | AACTTTAAAACCAAAGAGCC | 89 | 898 |
| 1040754 | N/A | N/A | 33435 | 33454 | TGTACAATAATATATTTCTT | 63 | 899 |
| 1040786 | N/A | N/A | 53693 | 53712 | GCAGAAATTCATTAAAAAGG | 44 | 900 |
| 1040818 | N/A | N/A | 78103 | 78122 | TACTGGTATATTTATTTGTT | 25 | 901 |
| 1040850 | N/A | N/A | 96906 | 96925 | CTTGAGTTTCATTATCTCCT | 62 | 902 |
| 1040882 | N/A | N/A | 122955 | 122974 | CATACATTCCCTTAAGCCAA | 45 | 903 |
| 1040914 | N/A | N/A | 154008 | 154027 | AGTATTATTTAAAACTACAT | 107 | 904 |
| 1040946 | N/A | N/A | 180271 | 180290 | CCATGGTTTCAAAGCTCTGT | 68 | 905 |
| 1040978 | N/A | N/A | 198120 | 198139 | AGCTATAAAATATAAACTTC | 116 | 906 |
| 1041010 | N/A | N/A | 218069 | 218088 | AGCTTTTGAATTTATTATGA | 63 | 907 |
| 1041042 | N/A | N/A | 240054 | 240073 | CAGAGACTATTTAAAGACG | 67 | 908 |
| 1041074 | N/A | N/A | 262925 | 262944 | CTCTTATTTTAAACTGGTGC | 17 | 909 |
| 1041106 | N/A | N/A | 279276 | 279295 | TTACTGATTATTTAACCCTG | 1 | 910 |
| 1041138 | N/A | N/A | 296194 | 296213 | AGTTCATTTTAAACTGTATT | 1 | 911 |
| 1041170 | N/A | N/A | 326365 | 326384 | TGTATTATTTTCTAACAGAA | 17 | 912 |
| 1041202 | N/A | N/A | 349100 | 349119 | AAGTATACAATTTAAGGATC | 18 | 913 |

TABLE 13-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041234 | N/A | N/A | 374001 | 374020 | ATTAGATTTCCTTACTGCAA | 16 | 914 |
| 1041266 | N/A | N/A | 395704 | 395723 | CCTCTCAAAACCACTTTTAT | 123 | 915 |
| 1041298 | N/A | N/A | 428253 | 428272 | CCCTCAATTCAAAGACAAAT | 128 | 916 |
| 1041330 | N/A | N/A | 437904 | 437923 | TTTCCTAATCAGGGTTCCTC | 24 | 917 |
| 1041362 | N/A | N/A | 438363 | 438382 | GTGCCCCCACTTTACGGTG | 35 | 918 |
| 1041394 | N/A | N/A | 438955 | 438974 | CCTGACTTTCATATGCAAAC | 23 | 919 |
| 1041426 | N/A | N/A | 439190 | 439209 | TTAACCATACTTCCAGTGAC | 49 | 920 |
| 1041458 | N/A | N/A | 439905 | 439924 | CCCCATATCCAGTCATTCAC | 91 | 921 |
| 1041490 | N/A | N/A | 440236 | 440255 | GCAATGACTCTTCACTCATG | 49 | 922 |
| 1041522 | N/A | N/A | 440800 | 440819 | GAGTAGGGAAAAACACACCT | 49 | 923 |
| 1041554 | N/A | N/A | 441434 | 441453 | AAGCTCAACAATTTGCACAT | 37 | 924 |
| 1041586 | N/A | N/A | 441742 | 441761 | ACGAACACAAAAACCCACAG | 65 | 925 |
| 1041618 | N/A | N/A | 442287 | 442306 | CCCCTTAAAAATCATCCCCA | 84 | 926 |
| 1041650 | N/A | N/A | 442825 | 442844 | AGCAGCTAACCTACTTCCTA | 34 | 927 |
| 1041682 | N/A | N/A | 443218 | 443237 | TCATACTCAGAAATACAGAT | 19 | 928 |
| 1041714 | N/A | N/A | 443616 | 443635 | TTAAGCAGCCACCGAGTCAG | 94 | 929 |
| 1041746 | N/A | N/A | 444023 | 444042 | GTGTATTACCAACAACTGCG | 8 | 930 |
| 1041778 | N/A | N/A | 444443 | 444462 | TTCATCAAAAACAGCATGTA | 85 | 931 |
| 1041810 | N/A | N/A | 445344 | 445363 | CACGCAAAGCCTGACTCAGT | 50 | 932 |
| 1041842 | N/A | N/A | 445673 | 445692 | TGAATTCTCTCATAAGCTAG | 96 | 933 |
| 1041874 | N/A | N/A | 445931 | 445950 | ACTATGCACATACACGCATA | 108 | 934 |
| 1041906 | N/A | N/A | 446163 | 446182 | ATCCATCCCCCTAAATCGAC | 54 | 935 |
| 1041938 | N/A | N/A | 446730 | 446749 | CATCCAGTAAATATATCCTG | 17 | 936 |
| 1041970 | N/A | N/A | 447020 | 447039 | CTTTACCGCCTAACAGGCAG | 123 | 937 |
| 1042002 | N/A | N/A | 447979 | 447998 | GATCCCCAACCCCCAGGCAA | 94 | 938 |
| 1042034 | N/A | N/A | 448606 | 448625 | TTTTACTACCTCCACCACCT | 61 | 939 |
| 1042066 | N/A | N/A | 448836 | 448855 | ACTCAAACTTAAAGTGACCT | 66 | 940 |
| 1042098 | N/A | N/A | 449409 | 449428 | TGGGTATTCTCTATGATGCT | 26 | 941 |
| 1042130 | N/A | N/A | 449713 | 449732 | TCATAGCAAATCTATCTTTA | 74 | 942 |
| 1042162 | N/A | N/A | 450017 | 450036 | GCTTCCTACCAAAGGAGCTG | 128 | 943 |
| 1042194 | N/A | N/A | 450686 | 450705 | GCAGCCAAACCTAAGTTCAG | 78 | 944 |
| 1042226 | N/A | N/A | 451252 | 451271 | AAGAAGTTCTCAACCTTCTT | 91 | 945 |
| 1042258 | N/A | N/A | 451699 | 451718 | GAAAGCCTTTCATTATTTCC | 29 | 946 |
| 1042290 | N/A | N/A | 452046 | 452065 | TAGTTCCAAACATGTCAGCC | 29 | 947 |
| 1042322 | N/A | N/A | 452353 | 452372 | GACAAATATACTTACAAGTG | 17 | 948 |
| 1042354 | N/A | N/A | 452664 | 452683 | CCCCCAAACCCATTTTCTTT | 121 | 949 |

TABLE 13-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042386 | N/A | N/A | 453191 | 453210 | TTGGATTTTATACACATTCA | 45 | 950 |
| 1042418 | N/A | N/A | 454294 | 454313 | GCTATAAATCAAAGACATCT | 61 | 951 |
| 1042450 | N/A | N/A | 455117 | 455136 | TGCTTACAATAATTAAGAAG | 75 | 952 |
| 1042482 | N/A | N/A | 455402 | 455421 | TTGTGACCCCAAAGCACTGT | 100 | 953 |
| 1042514 | N/A | N/A | 456708 | 456727 | GCTATTATCATACAGGACAG | 20 | 954 |

TABLE 14

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040083 | 902 | 921 | 435621 | 435640 | GATTTTAGTCTGATAAACGG | 32 | 955 |
| 1040115 | 2852 | 2871 | 437571 | 437590 | CGACGGCGAACTGTATCACG | 120 | 956 |
| 1040147 | 3386 | 3405 | 457639 | 457658 | TAGACCGGCCTTCAATGCAA | 41 | 957 |
| 1040179 | 4050 | 4069 | 458303 | 458322 | ATCTATACAATTAAAAGTTG | 116 | 958 |
| 1040211 | 4534 | 4553 | 458787 | 458806 | GAACAGTATTTTTAAATGCT | 13 | 959 |
| 1040243 | 4817 | 4836 | 459070 | 459089 | GAACTGATTCTCAGACATCA | 15 | 960 |
| 1040275 | 5323 | 5342 | 459576 | 459595 | ACCAAACATTAAATCTCGAT | 36 | 961 |
| 1040307 | 5636 | 5655 | 459889 | 459908 | GTTTATAAAAATCATTAGTC | 76 | 962 |
| 1040339 | 6064 | 6083 | 460317 | 460336 | GCTCCAAACCATGTGTGTTT | 23 | 963 |
| 1040371 | 6493 | 6512 | 460746 | 460765 | GCCTCCTTCCTCTCCACACT | 54 | 964 |
| 1040403 | 7244 | 7263 | 461497 | 461516 | TTCCACTTTAAAAGATCTGA | 34 | 965 |
| 1040435 | 7696 | 7715 | 461949 | 461968 | GGATTTTATGATTACTAGGA | 9 | 966 |
| 1040467 | 8151 | 8170 | 462404 | 462423 | GGCCTCCACGCCACTTAAAA | 144 | 967 |
| 1040499 | 8432 | 8451 | 462685 | 462704 | TGCTACAAGAAAAGATCCTA | 63 | 968 |
| 1040531 | 8722 | 8741 | 462975 | 462994 | ATAACCATACAAATCTGATC | 61 | 969 |
| 1040563 | 9124 | 9143 | 463377 | 463396 | TTACATTGAAATCATGTTTT | 48 | 970 |
| 1040595 | 9467 | 9486 | 463720 | 463739 | TGTATAGATACTACCTATTG | 53 | 971 |
| 1040627 | 9996 | 10015 | 464249 | 464268 | GGTCACCACAAATACTGACA | 29 | 972 |
| 1040659 | 10269 | 10288 | 464522 | 464541 | TGTCACAATAAAAGCTCTTA | 47 | 973 |
| 1040691 | 10563 | 10582 | 464816 | 464835 | ACTGGTATACAGACAATTTA | 80 | 974 |
| 1040723 | N/A | N/A | 19256 | 19275 | CCCAGCAAAGCCATCCAGTG | 80 | 975 |
| 1040755 | N/A | N/A | 33606 | 33625 | TTGATTACAATTTAAATTCA | 90 | 976 |
| 1040787 | N/A | N/A | 54456 | 54475 | AAGGGAATATTTTACTTTAT | 13 | 977 |
| 1040819 | N/A | N/A | 78391 | 78410 | CTATTATTATTTTACTGGCA | 7 | 978 |
| 1040851 | N/A | N/A | 97882 | 97901 | TTTTATAGCCACTAACCAAC | 96 | 979 |

TABLE 14-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040883 | N/A | N/A | 125349 | 125368 | AACATATTTCATTATAATTC | 100 | 980 |
| 1040915 | N/A | N/A | 154957 | 154976 | ACCCAGCATTTTAACATTA | 63 | 981 |
| 1040947 | N/A | N/A | 180483 | 180502 | CTTTCATTTATTTAGTGAAA | 116 | 982 |
| 1040979 | N/A | N/A | 200076 | 200095 | TTCCTTACTTTTTAGGATAC | 119 | 983 |
| 1041011 | N/A | N/A | 218138 | 218157 | GATTTATTTTAAAGTACTCT | 83 | 984 |
| 1041043 | N/A | N/A | 241942 | 241961 | GATTCCAAAACCAGACTTGT | 143 | 985 |
| 1041075 | N/A | N/A | 263175 | 263194 | CCATATATAGATTACAAAGC | 39 | 986 |
| 1041107 | N/A | N/A | 281181 | 281200 | TCTTTTAACCCTAAGACTGT | 67 | 987 |
| 1041139 | N/A | N/A | 296440 | 296459 | TGACAGTATTTTTAAAGACT | 2 | 988 |
| 1041171 | N/A | N/A | 326617 | 326636 | ACTGGCAAACCCAAAAGCTA | 103 | 989 |
| 1041203 | N/A | N/A | 349644 | 349663 | ACTGTTAAAACCCATCCAAC | 63 | 990 |
| 1041235 | N/A | N/A | 374559 | 374578 | ATGCAGTTCTAAAAGAAAGC | 66 | 991 |
| 1041267 | N/A | N/A | 397171 | 397190 | AGGCCCAAACCTCTAATCAA | 123 | 992 |
| 1041299 | N/A | N/A | 429792 | 429811 | AAGATTCAAATATATCTTAA | 130 | 993 |
| 1041331 | N/A | N/A | 437924 | 437943 | GGACCTGAAGTCCAGCAGCG | 60 | 994 |
| 1041363 | N/A | N/A | 438401 | 438420 | ACTCCCTCCACCTCCTGACC | 101 | 995 |
| 1041395 | N/A | N/A | 438956 | 438975 | GCCTGACTTTCATATGCAAA | 45 | 996 |
| 1041427 | N/A | N/A | 439210 | 439229 | GCCTGTGGAAATTAAGAGCG | 101 | 997 |
| 1041459 | N/A | N/A | 439912 | 439931 | TGCAAGCCCCCATATCCAGT | 45 | 998 |
| 1041491 | N/A | N/A | 440261 | 440280 | TTAAGGATTCTAAGTACCAT | 20 | 999 |
| 1041523 | N/A | N/A | 440821 | 440840 | TCATTAATTTTGCAAAGTTT | 19 | 1000 |
| 1041555 | N/A | N/A | 441445 | 441464 | TTTTGCTTATTAAGCTCAAC | 49 | 1001 |
| 1041587 | N/A | N/A | 441743 | 441762 | AACGAACACAAAAACCCACA | 105 | 1002 |
| 1041619 | N/A | N/A | 442289 | 442308 | AGCCCCTTAAAAATCATCCC | 116 | 1003 |
| 1041651 | N/A | N/A | 442826 | 442845 | AAGCAGCTAACCTACTTCCT | 53 | 1004 |
| 1041683 | N/A | N/A | 443220 | 443239 | GTTCATACTCAGAAATACAG | 33 | 1005 |
| 1041715 | N/A | N/A | 443625 | 443644 | CACTGAATATTAAGCAGCCA | 76 | 1006 |
| 1041747 | N/A | N/A | 444024 | 444043 | TGTGTATTACCAACAACTGC | 69 | 1007 |
| 1041779 | N/A | N/A | 444458 | 444477 | ACATGACATCATAAATTCAT | 38 | 1008 |
| 1041811 | N/A | N/A | 445353 | 445372 | AATCATGTTCACGCAAAGCC | 41 | 1009 |
| 1041843 | N/A | N/A | 445675 | 445694 | AATGAATTCTCTCATAAGCT | 69 | 1010 |
| 1041875 | N/A | N/A | 445943 | 445962 | CTATATCTAAACACTATGCA | 79 | 1011 |
| 1041907 | N/A | N/A | 446164 | 446183 | CATCCATCCCCCTAAATCGA | 100 | 1012 |
| 1041939 | N/A | N/A | 446731 | 446750 | TCATCCAGTAAATATATCCT | 21 | 1013 |
| 1041971 | N/A | N/A | 447021 | 447040 | GCTTTACCGCCTAACAGGCA | 92 | 1014 |
| 1042003 | N/A | N/A | 447994 | 448013 | CCTCTTTATACCAGGGATCC | 83 | 1015 |

TABLE 14-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042035 | N/A | N/A | 448607 | 448626 | TTTTTACTACCTCCACCACC | 93 | 1016 |
| 1042067 | N/A | N/A | 448839 | 448858 | GCAACTCAAACTTAAAGTGA | 46 | 1017 |
| 1042099 | N/A | N/A | 449410 | 449429 | ATGGGTATTCTCTATGATGC | 22 | 1018 |
| 1042131 | N/A | N/A | 449715 | 449734 | ATTCATAGCAAATCTATCTT | 102 | 1019 |
| 1042163 | N/A | N/A | 450018 | 450037 | TGCTTCCTACCAAAGGAGCT | 129 | 1020 |
| 1042195 | N/A | N/A | 450687 | 450706 | AGCAGCCAAACCTAAGTTCA | 61 | 1021 |
| 1042227 | N/A | N/A | 451307 | 451326 | ACCCTCTATTAAAAATACTA | 113 | 1022 |
| 1042259 | N/A | N/A | 451702 | 451721 | TTTGAAAGCCTTTCATTATT | 85 | 1023 |
| 1042291 | N/A | N/A | 452049 | 452068 | CCTTAGTTCCAAACATGTCA | 42 | 1024 |
| 1042323 | N/A | N/A | 452358 | 452377 | ACATAGACAAATATACTTAC | 31 | 1025 |
| 1042355 | N/A | N/A | 452665 | 452684 | GCCCCCAAACCCATTTTCTT | 113 | 1026 |
| 1042387 | N/A | N/A | 453354 | 453373 | ATGCACCACCACCACCACGC | 79 | 1027 |
| 1042419 | N/A | N/A | 454295 | 454314 | TGCTATAAATCAAAGACATC | 93 | 1028 |
| 1042451 | N/A | N/A | 455129 | 455148 | TTACAAAGACTATGCTTACA | 68 | 1029 |
| 1042483 | N/A | N/A | 455404 | 455423 | AGTTGTGACCCCAAAGCACT | 94 | 1030 |
| 1042515 | N/A | N/A | 456709 | 456728 | TGCTATTATCATACAGGACA | 21 | 1031 |

TABLE 15

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040084 | 909 | 928 | 435628 | 435647 | TGGCTCTGATTTTAGTCTGA | 34 | 1032 |
| 1040116 | 2895 | 2914 | 457148 | 457167 | TACTCTACCAAAACTTCAAC | 75 | 1033 |
| 1040148 | 3387 | 3406 | 457640 | 457659 | TTAGACCGGCCTTCAATGCA | 39 | 1034 |
| 1040180 | 4134 | 4153 | 458387 | 458406 | GCAGAAATGAAATCCCGCAT | 31 | 1035 |
| 1040212 | 4586 | 4605 | 458839 | 458858 | TGAGATACAGTACTTGTTGA | 12 | 1036 |
| 1040244 | 4866 | 4885 | 459119 | 459138 | TTCTCCATCCCTTTTCTCTC | 25 | 1037 |
| 1040276 | 5325 | 5344 | 459578 | 459597 | GTACCAAACATTAAATCTCG | 43 | 1038 |
| 1040308 | 5638 | 5657 | 459891 | 459910 | CGGTTTATAAAAATCATTAG | 80 | 1039 |
| 1040340 | 6065 | 6084 | 460318 | 460337 | TGCTCCAAACCATGTGTGTT | 42 | 1040 |
| 1040372 | 6500 | 6519 | 460753 | 460772 | TGAATCTGCCTCCTTCCTCT | 29 | 1041 |
| 1040404 | 7245 | 7264 | 461498 | 461517 | TTTCCACTTTAAAAGATCTG | 51 | 1042 |
| 1040436 | 7699 | 7718 | 461952 | 461971 | AGTGGATTTTATGATTACTA | 9 | 1043 |
| 1040468 | 8176 | 8195 | 462429 | 462448 | GGTTAAAAACAAATGTGGAA | 132 | 1044 |
| 1040500 | 8481 | 8500 | 462734 | 462753 | GCTTCTCAAATCAGGTGTAC | 11 | 1045 |

TABLE 15-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040532 | 8726 | 8745 | 462979 | 462998 | GGCCATAACCATACAAATCT | 74 | 1046 |
| 1040564 | 9177 | 9196 | 463430 | 463449 | GGCCTCTTTATATTAAATAA | 135 | 1047 |
| 1040596 | 9510 | 9529 | 463763 | 463782 | TCAGATAAGAAAAGTTATGG | 54 | 1048 |
| 1040628 | 9997 | 10016 | 464250 | 464269 | AGGTCACCACAAATACTGAC | 36 | 1049 |
| 1040660 | 10275 | 10294 | 464528 | 464547 | TTCTCCTGTCACAATAAAAG | 93 | 1050 |
| 1040692 | 10565 | 10584 | 464818 | 464837 | GTACTGGTATACAGACAATT | 95 | 1051 |
| 1040724 | N/A | N/A | 20058 | 20077 | GTCCTCAAAACCTATGGAGC | 127 | 1052 |
| 1040756 | N/A | N/A | 34396 | 34415 | TGGCTTAACCAGGGAGATGT | 13 | 1053 |
| 1040788 | N/A | N/A | 56211 | 56230 | ACTGATAATTTTTAGACATA | 41 | 1054 |
| 1040820 | N/A | N/A | 79273 | 79292 | ACCTCAATCATTTACTCTCT | 22 | 1055 |
| 1040852 | N/A | N/A | 99200 | 99219 | ACTCCTAAAATTTATTGAGG | 124 | 1056 |
| 1040884 | N/A | N/A | 127408 | 127427 | CCCTGAATAGTCTATGCCAT | 37 | 1057 |
| 1040916 | N/A | N/A | 155491 | 155510 | TTCCTTAAAATATGTTGGCA | 43 | 1058 |
| 1040948 | N/A | N/A | 181346 | 181365 | GGAAACAACCAAAAACTGCT | 32 | 1059 |
| 1040980 | N/A | N/A | 202475 | 202494 | TGACACAATATTTACTGTGT | 99 | 1060 |
| 1041012 | N/A | N/A | 218314 | 218333 | TCTCAGTTTCAAAATAGGAC | 32 | 1061 |
| 1041044 | N/A | N/A | 241960 | 241979 | CCTCAAAAAGAATCTGCAGA | 102 | 1062 |
| 1041076 | N/A | N/A | 263468 | 263487 | TCGGTTACTATTTACCTTTC | 60 | 1063 |
| 1041108 | N/A | N/A | 281316 | 281335 | GGACCCTAAATTTAAACAGC | 2 | 1064 |
| 1041140 | N/A | N/A | 296918 | 296937 | TGGAAATTTCAAAAGCTAA | 32 | 1065 |
| 1041172 | N/A | N/A | 327619 | 327638 | AACAACAAATAATTACCTAT | 114 | 1066 |
| 1041204 | N/A | N/A | 350026 | 350045 | AAGGAAAATCAAACATTGCT | 7 | 1067 |
| 1041236 | N/A | N/A | 375439 | 375458 | AGGTCTAGTATTTATCTTCT | 1 | 1068 |
| 1041268 | N/A | N/A | 398360 | 398379 | GAAACATTATTTTACTTTTC | 65 | 1069 |
| 1041300 | N/A | N/A | 430468 | 430487 | TCCTAAAAATACATCTTAAA | 102 | 1070 |
| 1041332 | N/A | N/A | 437957 | 437976 | CTGGTAAGAAAAGTGCCGA | 120 | 1071 |
| 1041364 | N/A | N/A | 438416 | 438435 | GCCACATTTCCCCTCACTCC | 23 | 1072 |
| 1041396 | N/A | N/A | 438957 | 438976 | AGCCTGACTTTCATATGCAA | 56 | 1073 |
| 1041428 | N/A | N/A | 439250 | 439269 | GTAATCGATCTAAGAACCTG | 21 | 1074 |
| 1041460 | N/A | N/A | 439916 | 439935 | TTTGTGCAAGCCCCCATATC | 103 | 1075 |
| 1041492 | N/A | N/A | 440277 | 440296 | TGTTCACAAAAATGTGTTAA | 71 | 1076 |
| 1041524 | N/A | N/A | 440828 | 440847 | CATTTAATCATTAATTTTGC | 63 | 1077 |
| 1041556 | N/A | N/A | 441446 | 441465 | ATTTTGCTTATTAAGCTCAA | 38 | 1078 |
| 1041588 | N/A | N/A | 441811 | 441830 | CCAATGATCCCATCACTGCA | 103 | 1079 |
| 1041620 | N/A | N/A | 442290 | 442309 | CAGCCCCTTAAAAATCATCC | 105 | 1080 |
| 1041652 | N/A | N/A | 442846 | 442865 | TGCCAGTTCCTGCATTTTCC | 8 | 1081 |

TABLE 15-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041684 | N/A | N/A | 443222 | 443241 | CAGTTCATACTCAGAAATAC | 50 | 1082 |
| 1041716 | N/A | N/A | 443626 | 443645 | GCACTGAATATTAAGCAGCC | 93 | 1083 |
| 1041748 | N/A | N/A | 444025 | 444044 | GTGTGTATTACCAACAACTG | 16 | 1084 |
| 1041780 | N/A | N/A | 444459 | 444478 | TACATGACATCATAAATTCA | 56 | 1085 |
| 1041812 | N/A | N/A | 445359 | 445378 | ACACTGAATCATGTTCACGC | 7 | 1086 |
| 1041844 | N/A | N/A | 445679 | 445698 | GAGCAATGAATTCTCTCATA | 27 | 1087 |
| 1041876 | N/A | N/A | 445945 | 445964 | TACTATATCTAAACACTATG | 115 | 1088 |
| 1041908 | N/A | N/A | 446169 | 446188 | TCCTCCATCCATCCCCCTAA | 75 | 1089 |
| 1041940 | N/A | N/A | 446740 | 446759 | CCCATTTTTTCATCCAGTAA | 12 | 1090 |
| 1041972 | N/A | N/A | 447022 | 447041 | GGCTTTACCGCCTAACAGGC | 107 | 1091 |
| 1042004 | N/A | N/A | 447996 | 448015 | CTCCTCTTTATACCAGGGAT | 85 | 1092 |
| 1042036 | N/A | N/A | 448608 | 448627 | TTTTTTACTACCTCCACCAC | 105 | 1093 |
| 1042068 | N/A | N/A | 448842 | 448861 | TGGGCAACTCAAACTTAAAG | 57 | 1094 |
| 1042100 | N/A | N/A | 449424 | 449443 | AATTTAAAACCCATATGGGT | 115 | 1095 |
| 1042132 | N/A | N/A | 449743 | 449762 | CACACATCTCAAATAGGTAC | 54 | 1096 |
| 1042164 | N/A | N/A | 450034 | 450053 | GCCTAAATTCTGCCTTTGCT | 35 | 1097 |
| 1042196 | N/A | N/A | 450690 | 450709 | GTGAGCAGCCAAACCTAAGT | 45 | 1098 |
| 1042228 | N/A | N/A | 451308 | 451327 | AACCCTCTATTAAAAATACT | 111 | 1099 |
| 1042260 | N/A | N/A | 451730 | 451749 | CTAAAGACTTCATAATGTTA | 58 | 1100 |
| 1042292 | N/A | N/A | 452051 | 452070 | AGCCTTAGTTCCAAACATGT | 107 | 1101 |
| 1042324 | N/A | N/A | 452368 | 452387 | GTGCATATATACATAGACAA | 8 | 1102 |
| 1042356 | N/A | N/A | 452666 | 452685 | GGCCCCCAAACCCATTTTCT | 114 | 1103 |
| 1042388 | N/A | N/A | 453520 | 453539 | AATATTTAAAATATTGTTGG | 120 | 1104 |
| 1042420 | N/A | N/A | 454296 | 454315 | CTGCTATAAATCAAAGACAT | 74 | 1105 |
| 1042452 | N/A | N/A | 455135 | 455154 | TAGACTTTACAAAGACTATG | 46 | 1106 |
| 1042484 | N/A | N/A | 455425 | 455444 | CTGGTGAGCCCCATTCTTTT | 39 | 1107 |
| 1042516 | N/A | N/A | 456710 | 456729 | CTGCTATTATCATACAGGAC | 18 | 1108 |

TABLE 16

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040085 | 964 | 983 | 435683 | 435702 | GTTGGATTTCATTTTTCGCC | 21 | 1109 |
| 1040117 | 2896 | 2915 | 457149 | 457168 | ATACTCTACCAAAACTTCAA | 90 | 1110 |
| 1040149 | 3411 | 3430 | 457664 | 457683 | CCACGCTGCCTCTACTTGCC | 49 | 1111 |

TABLE 16-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040181 | 4135 | 4154 | 458388 | 458407 | AGCAGAAATGAAATCCCGCA | 33 | 1112 |
| 1040213 | 4588 | 4607 | 458841 | 458860 | AGTGAGATACAGTACTTGTT | 11 | 1113 |
| 1040245 | 4889 | 4908 | 459142 | 459161 | ACTGGACAAAAATGAGTATT | 39 | 1114 |
| 1040277 | 5326 | 5345 | 459579 | 459598 | TGTACCAAACATTAAATCTC | 53 | 1115 |
| 1040309 | 5639 | 5658 | 459892 | 459911 | ACGGTTTATAAAAATCATTA | 71 | 1116 |
| 1040341 | 6066 | 6085 | 460319 | 460338 | TTGCTCCAAACCATGTGTGT | 37 | 1117 |
| 1040373 | 6641 | 6660 | 460894 | 460913 | CCACACTTCCCGTCCAGGCT | 19 | 1118 |
| 1040405 | 7293 | 7312 | 461546 | 461565 | CCAACATAGAAAATTATCCT | 27 | 1119 |
| 1040437 | 7702 | 7721 | 461955 | 461974 | AAGAGTGGATTTTATGATTA | 26 | 1120 |
| 1040469 | 8177 | 8196 | 462430 | 462449 | GGGTTAAAAACAAATGTGGA | 67 | 1121 |
| 1040501 | 8482 | 8501 | 462735 | 462754 | AGCTTCTCAAATCAGGTGTA | 14 | 1122 |
| 1040533 | 8732 | 8751 | 462985 | 463004 | CTTCCAGGCCATAACCATAC | 23 | 1123 |
| 1040565 | 9179 | 9198 | 463432 | 463451 | CTGGCCTCTTTATATTAAAT | 83 | 1124 |
| 1040597 | 9518 | 9537 | 463771 | 463790 | GAGTCCTTTCAGATAAGAAA | 18 | 1125 |
| 1040629 | 10046 | 10065 | 464299 | 464318 | CTCTGGAGCCAGGACTCCAC | 111 | 1126 |
| 1040661 | 10289 | 10308 | 464542 | 464561 | CATATGGAAAAAGTTCTCC | 69 | 1127 |
| 1040693 | 10566 | 10585 | 464819 | 464838 | TGTACTGGTATACAGACAAT | 79 | 1128 |
| 1040725 | N/A | N/A | 21690 | 21709 | CCAATAAAAGCCACAACTTG | 101 | 1129 |
| 1040757 | N/A | N/A | 34751 | 34770 | AAGGTGTATATTTATATGTT | 9 | 1130 |
| 1040789 | N/A | N/A | 56964 | 56983 | GCTCAAATTCAAAAGATGAA | 44 | 1131 |
| 1040821 | N/A | N/A | 79281 | 79300 | TCAGTAAAACCTCAATCATT | 51 | 1132 |
| 1040853 | N/A | N/A | 100126 | 100145 | TGGAATATTCTTTATTTTGG | 68 | 1133 |
| 1040885 | N/A | N/A | 127831 | 127850 | TTACTCTTTCAAATGCAAAA | 124 | 1134 |
| 1040917 | N/A | N/A | 157778 | 157797 | AGGTTCTATATTTAGAACAC | 143 | 1135 |
| 1040949 | N/A | N/A | 181515 | 181534 | CTCACAATTCAAAAGTTGTG | 93 | 1136 |
| 1040981 | N/A | N/A | 203086 | 203105 | TTAGTCAAACATATCAACCT | 52 | 1137 |
| 1041013 | N/A | N/A | 218395 | 218414 | GGCTGCAAACTATTCAAGTA | 99 | 1138 |
| 1041045 | N/A | N/A | 242013 | 242032 | TCATTATTAGATTACCAAGA | 36 | 1139 |
| 1041077 | N/A | N/A | 263601 | 263620 | CAGTAATTTCAAAAGGGCCA | 139 | 1140 |
| 1041109 | N/A | N/A | 281523 | 281542 | TGGATGCTATTTTATGTAGA | 3 | 1141 |
| 1041141 | N/A | N/A | 304301 | 304320 | GACCACAAAACCCAACTTAC | 41 | 1142 |
| 1041173 | N/A | N/A | 329293 | 329312 | TCAACAAATCAAATACTGAT | 94 | 1143 |
| 1041205 | N/A | N/A | 350846 | 350865 | TGCTGCATATTTTATATTTA | 21 | 1144 |
| 1041237 | N/A | N/A | 375452 | 375471 | AGTGTATTAGATTAGGTCTA | 3 | 1145 |
| 1041269 | N/A | N/A | 399227 | 399246 | CTCCTTAAACCCCATTTTAT | 79 | 1146 |
| 1041301 | N/A | N/A | 430469 | 430488 | CTCCTAAAAATACATCTTAA | 129 | 1147 |

TABLE 16-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041333 | N/A | N/A | 437958 | 437977 | CCTGGTAAGAAAAAGTGCCG | 126 | 1148 |
| 1041365 | N/A | N/A | 438420 | 438439 | GTTTGCCACATTTCCCCTCA | 20 | 1149 |
| 1041397 | N/A | N/A | 438974 | 438993 | CAGAGCTAATTCCTAGGAGC | 35 | 1150 |
| 1041429 | N/A | N/A | 439254 | 439273 | GCATGTAATCGATCTAAGAA | 16 | 1151 |
| 1041461 | N/A | N/A | 439954 | 439973 | TTCAGGGCTAAAAGCTCTCG | 113 | 1152 |
| 1041493 | N/A | N/A | 440278 | 440297 | CTGTTCACAAAAATGTGTTA | 54 | 1153 |
| 1041525 | N/A | N/A | 440829 | 440848 | TCATTTAATCATTAATTTTG | 109 | 1154 |
| 1041557 | N/A | N/A | 441447 | 441466 | GATTTTGCTTATTAAGCTCA | 23 | 1155 |
| 1041589 | N/A | N/A | 441816 | 441835 | GTGAGCCAATGATCCCATCA | 68 | 1156 |
| 1041621 | N/A | N/A | 442291 | 442310 | TCAGCCCCTTAAAAATCATC | 127 | 1157 |
| 1041653 | N/A | N/A | 442874 | 442893 | GGATATGTTCAGACTCAGAT | 7 | 1158 |
| 1041685 | N/A | N/A | 443223 | 443242 | CCAGTTCATACTCAGAAATA | 61 | 1159 |
| 1041717 | N/A | N/A | 443628 | 443647 | TGGCACTGAATATTAAGCAG | 52 | 1160 |
| 1041749 | N/A | N/A | 444026 | 444045 | AGTGTGTATTACCAACAACT | 13 | 1161 |
| 1041781 | N/A | N/A | 444482 | 444501 | CTGTATAATAATGTAATGCT | 6 | 1162 |
| 1041813 | N/A | N/A | 445369 | 445388 | TCTATTTAAAACACTGAATC | 88 | 1163 |
| 1041845 | N/A | N/A | 445681 | 445700 | GGGAGCAATGAATTCTCTCA | 111 | 1164 |
| 1041877 | N/A | N/A | 445946 | 445965 | CTACTATATCTAAACACTAT | 121 | 1165 |
| 1041909 | N/A | N/A | 446170 | 446189 | TTCCTCCATCCATCCCCCTA | 108 | 1166 |
| 1041941 | N/A | N/A | 446742 | 446761 | AGCCCATTTTTTCATCCAGT | 7 | 1167 |
| 1041973 | N/A | N/A | 447025 | 447044 | TGTGGCTTTACCGCCTAACA | 106 | 1168 |
| 1042005 | N/A | N/A | 447997 | 448016 | TCTCCTCTTTATACCAGGGA | 47 | 1169 |
| 1042037 | N/A | N/A | 448611 | 448630 | TATTTTTTACTACCTCCAC | 72 | 1170 |
| 1042069 | N/A | N/A | 448882 | 448901 | AGTGACCACACTATCCGATG | 28 | 1171 |
| 1042101 | N/A | N/A | 449428 | 449447 | CTTGAATTTAAAACCCATAT | 83 | 1172 |
| 1042133 | N/A | N/A | 449745 | 449764 | TGCACACATCTCAAATAGGT | 40 | 1173 |
| 1042165 | N/A | N/A | 450037 | 450056 | TTTGCCTAAATTCTGCCTTT | 68 | 1174 |
| 1042197 | N/A | N/A | 450727 | 450746 | CTCACCAACCTCATCTCTCG | 98 | 1175 |
| 1042229 | N/A | N/A | 451449 | 451468 | ACAACTAACTATATATTGTT | 97 | 1176 |
| 1042261 | N/A | N/A | 451738 | 451757 | GTTTCCCTCTAAAGACTTCA | 17 | 1177 |
| 1042293 | N/A | N/A | 452058 | 452077 | GACCAGAAGCCTTAGTTCCA | 26 | 1178 |
| 1042325 | N/A | N/A | 452384 | 452403 | ACACAGAAACATATATGTGC | 87 | 1179 |
| 1042357 | N/A | N/A | 452669 | 452688 | ATTGGCCCCAAACCCATTT | 83 | 1180 |
| 1042389 | N/A | N/A | 453547 | 453566 | TCTGAATGAATATTGGCTAT | 21 | 1181 |

TABLE 16-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042421 | N/A | N/A | 454309 | 454328 | GATGAGAATTAAACTGCTAT | 66 | 1182 |
| 1042453 | N/A | N/A | 455147 | 455166 | GAGTCATACATATAGACTTT | 132 | 1183 |
| 1042485 | N/A | N/A | 455452 | 455471 | TCAGGATACACCAAGGGAGG | 82 | 1184 |
| 1042517 | N/A | N/A | 456712 | 456731 | AACTGCTATTATCATACAGG | 57 | 1185 |

TABLE 17

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040086 | 1112 | 1131 | 435831 | 435850 | CCCGGCCACCAGGGTTGCCC | 110 | 1186 |
| 1040118 | 2897 | 2916 | 457150 | 457169 | GATACTCTACCAAAACTTCA | 64 | 1187 |
| 1040150 | 3412 | 3431 | 457665 | 457684 | CCCACGCTGCCTCTACTTGC | 56 | 1188 |
| 1040182 | 4147 | 4166 | 458400 | 458419 | GCACTAGTAAAAGCAGAAA | 72 | 1189 |
| 1040214 | 4594 | 4613 | 458847 | 458866 | GTTTAAAGTGAGATACAGTA | 15 | 1190 |
| 1040246 | 4923 | 4942 | 459176 | 459195 | AGGTTCTTTAAAAGTTCATC | 12 | 1191 |
| 1040278 | 5330 | 5349 | 459583 | 459602 | GGTTTGTACCAAACATTAAA | 106 | 1192 |
| 1040310 | 5652 | 5671 | 459905 | 459924 | TACACCCCAGAAAACGGTTT | 124 | 1193 |
| 1040342 | 6069 | 6088 | 460322 | 460341 | CTATTGCTCCAAACCATGTG | 39 | 1194 |
| 1040374 | 6678 | 6697 | 460931 | 460950 | ACTGGCCAACACGCTCAGAA | 102 | 1195 |
| 1040406 | 7294 | 7313 | 461547 | 461566 | ACCAACATAGAAAATTATCC | 30 | 1196 |
| 1040438 | 7722 | 7741 | 461975 | 461994 | AGTAAAGATCAAACTGTGCA | 14 | 1197 |
| 1040470 | 8178 | 8197 | 462431 | 462450 | TGGGTTAAAAACAAATGTGG | 81 | 1198 |
| 1040502 | 8484 | 8503 | 462737 | 462756 | TCAGCTTCTCAAATCAGGTG | 13 | 1199 |
| 1040534 | 8740 | 8759 | 462993 | 463012 | TAGTAATTCTTCCAGGCCAT | 23 | 1200 |
| 1040566 | 9181 | 9200 | 463434 | 463453 | TTCTGGCCTCTTTATATTAA | 30 | 1201 |
| 1040598 | 9521 | 9540 | 463774 | 463793 | CTTGAGTCCTTTCAGATAAG | 28 | 1202 |
| 1040630 | 10087 | 10106 | 464340 | 464359 | TCTGATATTAAAACATCCAG | 34 | 1203 |
| 1040662 | 10290 | 10309 | 464543 | 464562 | GCATATGGAAAAAGTTCTC | 24 | 1204 |
| 1040694 | 10583 | 10602 | 464836 | 464855 | TACTGAAACAATAAACTTGT | 102 | 1205 |
| 1040726 | N/A | N/A | 22134 | 22153 | TCTTCCTCCTTTTATATCTG | 30 | 1206 |
| 1040758 | N/A | N/A | 34802 | 34821 | GGATTAAAAATTATGACCTC | 57 | 1207 |
| 1040790 | N/A | N/A | 59689 | 59708 | GGAGCAGTTCCTTAACTATC | 20 | 1208 |
| 1040822 | N/A | N/A | 79548 | 79567 | CCCCTTACCCAAACCCTTGG | 124 | 1209 |
| 1040854 | N/A | N/A | 102583 | 102602 | AGAGATAATTTTTAATGCAG | 34 | 1210 |
| 1040886 | N/A | N/A | 129211 | 129230 | CCATTAAACATTTATTTTGC | 11 | 1211 |

TABLE 17-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040918 | N/A | N/A | 158178 | 158197 | TCTATATTCCCTTAACCGTA | 32 | 1212 |
| 1040950 | N/A | N/A | 182959 | 182978 | CATTTTCAACCTTATGATAT | 42 | 1213 |
| 1040982 | N/A | N/A | 203492 | 203511 | CAGACATTCCTTTAATATGC | 17 | 1214 |
| 1041014 | N/A | N/A | 218412 | 218431 | TAGAACTTTTAAAGCAAGGC | 52 | 1215 |
| 1041046 | N/A | N/A | 242061 | 242080 | AGTCAAATAGTCTATCAGTA | 11 | 1216 |
| 1041078 | N/A | N/A | 263847 | 263866 | ACATGATTTTAAAAGTCTTA | 73 | 1217 |
| 1041110 | N/A | N/A | 281874 | 281893 | TCCCCACACCCTTAAACTGC | 115 | 1218 |
| 1041142 | N/A | N/A | 310242 | 310261 | TACACATAAATTTATATCTG | 78 | 1219 |
| 1041174 | N/A | N/A | 329490 | 329509 | TGGTTCTATATTTATGTACC | 25 | 1220 |
| 1041206 | N/A | N/A | 353449 | 353468 | TTGTCTAAACCTGTTTGAGG | 6 | 1221 |
| 1041238 | N/A | N/A | 375665 | 375684 | GCTACCAAAATACAGAACTT | 66 | 1222 |
| 1041270 | N/A | N/A | 399709 | 399728 | GCACCATTTTAAAAATGGCT | 123 | 1223 |
| 1041302 | N/A | N/A | 430826 | 430845 | TCATCTAAACCTAATACGGC | 99 | 1224 |
| 1041334 | N/A | N/A | 437968 | 437987 | TCTGTCTTTTCCTGGTAAGA | 11 | 1225 |
| 1041366 | N/A | N/A | 438425 | 438444 | CTGTTGTTTGCCACATTTCC | 9 | 1226 |
| 1041398 | N/A | N/A | 438975 | 438994 | CCAGAGCTAATTCCTAGGAG | 4 | 1227 |
| 1041430 | N/A | N/A | 439288 | 439307 | TTGGGCAGTGAAAGAAATGG | 74 | 1228 |
| 1041462 | N/A | N/A | 439989 | 440008 | ACCTACAGTGACATCTCATA | 63 | 1229 |
| 1041494 | N/A | N/A | 440279 | 440298 | TCTGTTCACAAAAATGTGTT | 94 | 1230 |
| 1041526 | N/A | N/A | 440834 | 440853 | CTCTTTCATTTAATCATTAA | 47 | 1231 |
| 1041558 | N/A | N/A | 441464 | 441483 | TCCCCAATCAAATTTGTGAT | 62 | 1232 |
| 1041590 | N/A | N/A | 441897 | 441916 | GTAGTGGTACACACCCATAG | 77 | 1233 |
| 1041622 | N/A | N/A | 442320 | 442339 | GGCATCTTTCCACAGTCTTA | 43 | 1234 |
| 1041654 | N/A | N/A | 442947 | 442966 | CCGAGCCATCTAAGTTGAAG | 30 | 1235 |
| 1041686 | N/A | N/A | 443225 | 443244 | ATCCAGTTCATACTCAGAAA | 29 | 1236 |
| 1041718 | N/A | N/A | 443659 | 443678 | CACCCACGCCAGGACAGTCG | 128 | 1237 |
| 1041750 | N/A | N/A | 444049 | 444068 | TTCCAGCACCAGAACAGACA | 116 | 1238 |
| 1041782 | N/A | N/A | 444483 | 444502 | TCTGTATAATAATGTAATGC | 11 | 1239 |
| 1041814 | N/A | N/A | 445371 | 445390 | GTTCTATTTAAAACACTGAA | 25 | 1240 |
| 1041846 | N/A | N/A | 445703 | 445722 | CATACAAATTTCGCCTGTTG | 55 | 1241 |
| 1041878 | N/A | N/A | 445947 | 445966 | ACTACTATATCTAAACACTA | 109 | 1242 |
| 1041910 | N/A | N/A | 446176 | 446195 | TACCCCTTCCTCCATCCATC | 88 | 1243 |
| 1041942 | N/A | N/A | 446750 | 446769 | CTCAATATAGCCCATTTTTT | 47 | 1244 |
| 1041974 | N/A | N/A | 447063 | 447082 | GACCTCCCCAGGGAGAGGA | 75 | 1245 |
| 1042006 | N/A | N/A | 447998 | 448017 | TTCTCCTCTTTATACCAGGG | 12 | 1246 |
| 1042038 | N/A | N/A | 448613 | 448632 | ACTATTTTTTACTACCTCC | 54 | 1247 |

TABLE 17-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042070 | N/A | N/A | 448885 | 448904 | ACCAGTGACCACACTATCCG | 45 | 1248 |
| 1042102 | N/A | N/A | 449429 | 449448 | CCTTGAATTTAAAACCCATA | 42 | 1249 |
| 1042134 | N/A | N/A | 449762 | 449781 | GAAAGTTAAAATCTTGTTGC | 57 | 1250 |
| 1042166 | N/A | N/A | 450040 | 450059 | CTTTTTGCCTAAATTCTGCC | 70 | 1251 |
| 1042198 | N/A | N/A | 450728 | 450747 | TCTCACCAACCTCATCTCTC | 77 | 1252 |
| 1042230 | N/A | N/A | 451450 | 451469 | AACAACTAACTATATATTGT | 112 | 1253 |
| 1042262 | N/A | N/A | 451767 | 451786 | AGTGCAAAAGTCAGGATACA | 12 | 1254 |
| 1042294 | N/A | N/A | 452064 | 452083 | TCAGAAGACCAGAAGCCTTA | 62 | 1255 |
| 1042326 | N/A | N/A | 452397 | 452416 | ACATTTACATCACACACAGA | 104 | 1256 |
| 1042358 | N/A | N/A | 452685 | 452704 | GGATTTTATCCCAGTCATTG | 57 | 1257 |
| 1042390 | N/A | N/A | 453577 | 453596 | GAGGAATGAAAATGGTAGAT | 25 | 1258 |
| 1042422 | N/A | N/A | 454311 | 454330 | CAGATGAGAATTAAACTGCT | 62 | 1259 |
| 1042454 | N/A | N/A | 455148 | 455167 | AGAGTCATACATATAGACTT | 129 | 1260 |
| 1042486 | N/A | N/A | 455459 | 455478 | ATGGAGTTCAGGATACACCA | 54 | 1261 |
| 1042518 | N/A | N/A | 456740 | 456759 | GGTCTTAGATTTTATGAGCT | 16 | 1262 |

TABLE 18

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040087 | 1115 | 1134 | 435834 | 435853 | GGCCCCGGCCACCAGGGTTG | 104 | 1263 |
| 1040119 | 2898 | 2917 | 457151 | 457170 | GGATACTCTACCAAAACTTC | 20 | 1264 |
| 1040151 | 3423 | 3442 | 457676 | 457695 | GTTTCCTTTCCCCCACGCTG | 23 | 1265 |
| 1040183 | 4148 | 4167 | 458401 | 458420 | TGCACTAGTAAAAAGCAGAA | 99 | 1266 |
| 1040215 | 4609 | 4628 | 458862 | 458881 | TTTTTTCCCCAAAGAGTTTA | 37 | 1267 |
| 1040247 | 4924 | 4943 | 459177 | 459196 | AAGGTTCTTTAAAAGTTCAT | 20 | 1268 |
| 1040279 | 5332 | 5351 | 459585 | 459604 | TGGGTTTGTACCAAACATTA | 59 | 1269 |
| 1040311 | 5676 | 5695 | 459929 | 459948 | CTAAACCTATTCAAATGTTT | 90 | 1270 |
| 1040343 | 6078 | 6097 | 460331 | 460350 | ATGATGTTCCTATTGCTCCA | 11 | 1271 |
| 1040375 | 6750 | 6769 | 461003 | 461022 | TCTTCCTATTTGAAGAGAAA | 64 | 1272 |
| 1040407 | 7311 | 7330 | 461564 | 461583 | GGGAAAACGAAAAGTTGACC | 29 | 1273 |
| 1040439 | 7724 | 7743 | 461977 | 461996 | TCAGTAAAGATCAAACTGTG | 103 | 1274 |
| 1040471 | 8180 | 8199 | 462433 | 462452 | TCTGGGTTAAAAACAAATGT | 69 | 1275 |
| 1040503 | 8486 | 8505 | 462739 | 462758 | CTTCAGCTTCTCAAATCAGG | 26 | 1276 |
| 1040535 | 8767 | 8786 | 463020 | 463039 | ATAGGTATAGTTTAAGAGCC | 22 | 1277 |

TABLE 18 -continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040567 | 9195 | 9214 | 463448 | 463467 | ATGCTCCGTATTTATTCTGG | 9 | 1278 |
| 1040599 | 9523 | 9542 | 463776 | 463795 | GACTTGAGTCCTTTCAGATA | 32 | 1279 |
| 1040631 | 10088 | 10107 | 464341 | 464360 | ATCTGATATTAAAACATCCA | 33 | 1280 |
| 1040663 | 10327 | 10346 | 464580 | 464599 | TACAATATTTTACACTGGAA | 11 | 1281 |
| 1040695 | 10609 | 10628 | 464862 | 464881 | GCACTGTTATTTTATTAGTA | 41 | 1282 |
| 1040727 | N/A | N/A | 22675 | 22694 | CTGTGGTTTTAAAGGCTGTA | 4 | 1283 |
| 1040759 | N/A | N/A | 34869 | 34888 | GGTTTTAAAAACATCCTCCT | 41 | 1284 |
| 1040791 | N/A | N/A | 63051 | 63070 | TTTTAGCACCTTTAAACTCT | 85 | 1285 |
| 1040823 | N/A | N/A | 79759 | 79778 | CTCTCATTTTAAAGTTTTCT | 44 | 1286 |
| 1040855 | N/A | N/A | 103256 | 103275 | ATCTTTATTCAAAAATGCAA | 88 | 1287 |
| 1040887 | N/A | N/A | 132848 | 132867 | TTCATGTTTTAAAGCTGAGA | 11 | 1288 |
| 1040919 | N/A | N/A | 158451 | 158470 | CTCACAATTCAAAATTATTC | 44 | 1289 |
| 1040951 | N/A | N/A | 182994 | 183013 | AACCTTAGAAATGTACATTT | 29 | 1290 |
| 1040983 | N/A | N/A | 204258 | 204277 | CTAGCAATTCAAAACAATAT | 45 | 1291 |
| 1041015 | N/A | N/A | 219043 | 219062 | CTTCTCCTTCCTTAATAGAT | 65 | 1292 |
| 1041047 | N/A | N/A | 243398 | 243417 | TCTCAAGGCCCTTAATTGCC | 67 | 1293 |
| 1041079 | N/A | N/A | 264140 | 264159 | ACTTTTAAATCCCCCTAAAG | 105 | 1294 |
| 1041111 | N/A | N/A | 281939 | 281958 | CTCACATTTCTTTATACACA | 2 | 1295 |
| 1041143 | N/A | N/A | 311352 | 311371 | GTGAGATTTTAAAGACATTC | 1 | 1296 |
| 1041175 | N/A | N/A | 330016 | 330035 | GATGCCAAACTATTATCTCA | 7 | 1297 |
| 1041207 | N/A | N/A | 354249 | 354268 | AGACAATTTTAAAAGCTTCC | 8 | 1298 |
| 1041239 | N/A | N/A | 375816 | 375835 | TCTCTTAACCAAAGAATCTG | 132 | 1299 |
| 1041271 | N/A | N/A | 400962 | 400981 | ATGCTGTTCCTTTATAACGG | 16 | 1300 |
| 1041303 | N/A | N/A | 431185 | 431204 | AATTTCTAAATTTAGCCCAG | 55 | 1301 |
| 1041335 | N/A | N/A | 437990 | 438009 | TCCCCTCACTCCAACGGCAT | 80 | 1302 |
| 1041367 | N/A | N/A | 438448 | 438467 | CTCCCATGAAACCACAATAA | 142 | 1303 |
| 1041399 | N/A | N/A | 439002 | 439021 | CTGACTTTATATGCAAACC | 25 | 1304 |
| 1041431 | N/A | N/A | 439344 | 439363 | CTCGATAGCCAGGAAAGCTC | 64 | 1305 |
| 1041463 | N/A | N/A | 439996 | 440015 | ACTGTAAACCTACAGTGACA | 130 | 1306 |
| 1041495 | N/A | N/A | 440280 | 440299 | CTCTGTTCACAAAAATGTGT | 95 | 1307 |
| 1041527 | N/A | N/A | 440836 | 440855 | TTCTCTTTCATTTAATCATT | 16 | 1308 |
| 1041559 | N/A | N/A | 441465 | 441484 | TTCCCCAATCAAATTTGTGA | 83 | 1309 |
| 1041591 | N/A | N/A | 442071 | 442090 | GAGATTATCTCCTATGAAGA | 50 | 1310 |
| 1041623 | N/A | N/A | 442374 | 442393 | AGCATTTTCTCCTACATTG | 14 | 1311 |
| 1041655 | N/A | N/A | 442950 | 442969 | GGCCCGAGCCATCTAAGTTG | 129 | 1312 |
| 1041687 | N/A | N/A | 443226 | 443245 | AATCCAGTTCATACTCAGAA | 47 | 1313 |

TABLE 18 -continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041719 | N/A | N/A | 443664 | 443683 | ACTCACACCCACGCCAGGAC | 109 | 1314 |
| 1041751 | N/A | N/A | 444094 | 444113 | CCACAAACAAAAATGTGGTT | 79 | 1315 |
| 1041783 | N/A | N/A | 444487 | 444506 | CTGTTCTGTATAATAATGTA | 48 | 1316 |
| 1041815 | N/A | N/A | 445372 | 445391 | TGTTCTATTTAAAACACTGA | 62 | 1317 |
| 1041847 | N/A | N/A | 445705 | 445724 | GACATACAAATTTCGCCTGT | 22 | 1318 |
| 1041879 | N/A | N/A | 445948 | 445967 | AACTACTATATCTAAACACT | 95 | 1319 |
| 1041911 | N/A | N/A | 446181 | 446200 | CTGCCTACCCCTTCCTCCAT | 80 | 1320 |
| 1041943 | N/A | N/A | 446755 | 446774 | GACAGCTAATATAGCCCAT | 28 | 1321 |
| 1041975 | N/A | N/A | 447085 | 447104 | AGCCAGAACTAAAGTGGGCT | 74 | 1322 |
| 1042007 | N/A | N/A | 448000 | 448019 | CCTTCTCCTCTTTATACCAG | 35 | 1323 |
| 1042039 | N/A | N/A | 448615 | 448634 | ATACTATTTTTTTACTACCT | 65 | 1324 |
| 1042071 | N/A | N/A | 448888 | 448907 | GACACCAGTGACCACACTAT | 46 | 1325 |
| 1042103 | N/A | N/A | 449430 | 449449 | TCCTTGAATTTAAAACCCAT | 55 | 1326 |
| 1042135 | N/A | N/A | 449763 | 449782 | TGAAAGTTAAAATCTTGTTG | 75 | 1327 |
| 1042167 | N/A | N/A | 450041 | 450060 | TCTTTTTGCCTAAATTCTGC | 43 | 1328 |
| 1042199 | N/A | N/A | 450731 | 450750 | TCCTCTCACCAACCTCATCT | 77 | 1329 |
| 1042231 | N/A | N/A | 451490 | 451509 | CTTTTAGAAACTAACTCTGG | 107 | 1330 |
| 1042263 | N/A | N/A | 451782 | 451801 | GTACTATAATTGATTAGTGC | 50 | 1331 |
| 1042295 | N/A | N/A | 452071 | 452090 | GTGACATTCAGAAGACCAGA | 15 | 1332 |
| 1042327 | N/A | N/A | 452400 | 452419 | ACTACATTTACATCACACAC | 83 | 1333 |
| 1042359 | N/A | N/A | 452688 | 452707 | TTAGGATTTTATCCCAGTCA | 28 | 1334 |
| 1042391 | N/A | N/A | 453658 | 453677 | GCATTATAGAAAATACTAAA | 85 | 1335 |
| 1042423 | N/A | N/A | 454312 | 454331 | GCAGATGAGAATTAAACTGC | 100 | 1336 |
| 1042455 | N/A | N/A | 455154 | 455173 | TCATATAGAGTCATACATAT | 45 | 1337 |
| 1042487 | N/A | N/A | 455532 | 455551 | TGAACATTCCAAAGTGGAGC | 44 | 1338 |
| 1042519 | N/A | N/A | 456742 | 456761 | GCGGTCTTAGATTTTATGAG | 24 | 1339 |

TABLE 19

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040088 | 1144 | 1163 | 435863 | 435882 | CCCTGCCGGCCCATGCCTCC | 159 | 1340 |
| 1040120 | 2908 | 2927 | 457161 | 457180 | CACAAAAAAGGATACTCTA | 104 | 1341 |
| 1040152 | 3453 | 3472 | 457706 | 457725 | ATCTGGATACAAATGATAAG | 50 | 1342 |
| 1040184 | 4176 | 4195 | 458429 | 458448 | GTCCACCACAACACCCTGGT | 78 | 1343 |

TABLE 19-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040216 | 4671 | 4690 | 458924 | 458943 | CAGAGCTGAAATGTAGTTAC | 12 | 1344 |
| 1040248 | 4926 | 4945 | 459179 | 459198 | GCAAGGTTCTTTAAAAGTTC | 11 | 1345 |
| 1040280 | 5347 | 5366 | 459600 | 459619 | ATGAAATACCCTTTCTGGGT | 124 | 1346 |
| 1040312 | 5684 | 5703 | 459937 | 459956 | TAGCTATTCTAAACCTATTC | 140 | 1347 |
| 1040344 | 6080 | 6099 | 460333 | 460352 | TGATGATGTTCCTATTGCTC | 15 | 1348 |
| 1040376 | 6870 | 6889 | 461123 | 461142 | GAAGAATTTCTACCCCTGTC | 39 | 1349 |
| 1040408 | 7336 | 7355 | 461589 | 461608 | ATCCCAAACTAAACTGGGTG | 105 | 1350 |
| 1040440 | 7732 | 7751 | 461985 | 462004 | AACATATTTCAGTAAAGATC | 13 | 1351 |
| 1040472 | 8194 | 8213 | 462447 | 462466 | TCTATTTCAGAAATTCTGGG | 11 | 1352 |
| 1040504 | 8505 | 8524 | 462758 | 462777 | TGCTTCAAAATTTTGTTTTC | 40 | 1353 |
| 1040536 | 8815 | 8834 | 463068 | 463087 | TTCCCCTCCCTCAGACGAGG | 109 | 1354 |
| 1040568 | 9206 | 9225 | 463459 | 463478 | ATTCTGAGAAGATGCTCCGT | 35 | 1355 |
| 1040600 | 9525 | 9544 | 463778 | 463797 | AAGACTTGAGTCCTTTCAGA | 26 | 1356 |
| 1040632 | 10089 | 10108 | 464342 | 464361 | GATCTGATATTAAAACATCC | 20 | 1357 |
| 1040664 | 10329 | 10348 | 464582 | 464601 | AGTACAATATTTTACACTGG | 14 | 1358 |
| 1040696 | N/A | N/A | 5825 | 5844 | GTCAAGTTTTAAAATGTGAC | 68 | 1359 |
| 1040728 | N/A | N/A | 22774 | 22793 | ACTGAAACAATTTATCTAAG | 83 | 1360 |
| 1040760 | N/A | N/A | 36098 | 36117 | ACAAAAATAATTTAAGCCAC | 106 | 1361 |
| 1040792 | N/A | N/A | 63073 | 63092 | TACTATCACCTTTAAACTTT | 71 | 1362 |
| 1040824 | N/A | N/A | 80953 | 80972 | ACCGCCAAAACCAACCAGGG | 65 | 1363 |
| 1040856 | N/A | N/A | 103405 | 103424 | CTAATCTATCAAATAAAGGA | 105 | 1364 |
| 1040888 | N/A | N/A | 133117 | 133136 | GAGAGGTTTCATTATGTAAA | 5 | 1365 |
| 1040920 | N/A | N/A | 158507 | 158526 | GCACTTAGACAATGCTGCAG | 106 | 1366 |
| 1040952 | N/A | N/A | 183278 | 183297 | GGTAAGTTATTTTAAAACTT | 76 | 1367 |
| 1040984 | N/A | N/A | 205648 | 205667 | AGTTTTACGATATATGAATC | 81 | 1368 |
| 1041016 | N/A | N/A | 219199 | 219218 | TACCATTATTTTTAGCTTTT | 18 | 1369 |
| 1041048 | N/A | N/A | 243460 | 243479 | CAGTTTATTCTTTACCCAAA | 10 | 1370 |
| 1041080 | N/A | N/A | 264569 | 264588 | CCCACATTTTAAAGATGCAG | 46 | 1371 |
| 1041112 | N/A | N/A | 282392 | 282411 | TCCAGAAACCTTTATTATTG | 1 | 1372 |
| 1041144 | N/A | N/A | 311667 | 311686 | AACAGGTTACAAATACGGTT | 1 | 1373 |
| 1041176 | N/A | N/A | 330322 | 330341 | ATTCTGTTTTAAATTCCTTT | 1 | 1374 |
| 1041208 | N/A | N/A | 354293 | 354312 | ATGCAATTTCAAAAGCTGGC | 10 | 1375 |
| 1041240 | N/A | N/A | 376063 | 376082 | GTGGATACTTTTTAAAACTC | 2 | 1376 |
| 1041272 | N/A | N/A | 401167 | 401186 | GTCGCAAACCTTTATGGAGT | 6 | 1377 |
| 1041304 | N/A | N/A | 431998 | 432017 | CAAATCCAAATTTATTCTTC | 76 | 1378 |
| 1041336 | N/A | N/A | 437997 | 438016 | CATCTAATCCCCTCACTCCA | 92 | 1379 |

TABLE 19-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041368 | N/A | N/A | 438450 | 438469 | GCCTCCCATGAAACCACAAT | 122 | 1380 |
| 1041400 | N/A | N/A | 439003 | 439022 | CCTGACTTTTATATGCAAAC | 11 | 1381 |
| 1041432 | N/A | N/A | 439351 | 439370 | AAGTACGCTCGATAGCCAGG | 22 | 1382 |
| 1041464 | N/A | N/A | 439999 | 440018 | AAGACTGTAAACCTACAGTG | 101 | 1383 |
| 1041496 | N/A | N/A | 440281 | 440300 | CCTCTGTTCACAAAAATGTG | 121 | 1384 |
| 1041528 | N/A | N/A | 440838 | 440857 | ATTTCTCTTTCATTTAATCA | 33 | 1385 |
| 1041560 | N/A | N/A | 441466 | 441485 | CTTCCCCAATCAAATTTGTG | 87 | 1386 |
| 1041592 | N/A | N/A | 442072 | 442091 | AGAGATTATCTCCTATGAAG | 70 | 1387 |
| 1041624 | N/A | N/A | 442397 | 442416 | AGGGATAGTGACAAACACGG | 8 | 1388 |
| 1041656 | N/A | N/A | 442952 | 442971 | AGGGCCCGAGCCATCTAAGT | 122 | 1389 |
| 1041688 | N/A | N/A | 443233 | 443252 | CCCCTCAAATCCAGTTCATA | 111 | 1390 |
| 1041720 | N/A | N/A | 443705 | 443724 | CATCATGATAACAACTGCTG | 47 | 1391 |
| 1041752 | N/A | N/A | 444095 | 444114 | CCCACAAACAAAAATGTGGT | 100 | 1392 |
| 1041784 | N/A | N/A | 444575 | 444594 | GAGTAAAATGATCAGTGGGT | 15 | 1393 |
| 1041816 | N/A | N/A | 445373 | 445392 | GTGTTCTATTTAAAACACTG | 107 | 1394 |
| 1041848 | N/A | N/A | 445706 | 445725 | AGACATACAAATTTCGCCTG | 45 | 1395 |
| 1041880 | N/A | N/A | 445954 | 445973 | GTCAATAACTACTATATCTA | 54 | 1396 |
| 1041912 | N/A | N/A | 446182 | 446201 | TCTGCCTACCCCTTCCTCCA | 61 | 1397 |
| 1041944 | N/A | N/A | 446788 | 446807 | CCACAGATAACCAAAGCACG | 37 | 1398 |
| 1041976 | N/A | N/A | 447087 | 447106 | CCAGCCAGAACTAAAGTGGG | 75 | 1399 |
| 1042008 | N/A | N/A | 448004 | 448023 | GGCCCCTTCTCCTCTTTATA | 118 | 1400 |
| 1042040 | N/A | N/A | 448617 | 448636 | TGATACTATTTTTTTACTAC | 97 | 1401 |
| 1042072 | N/A | N/A | 448922 | 448941 | GAGACAGAACATACACGCAA | 35 | 1402 |
| 1042104 | N/A | N/A | 449432 | 449451 | ATTCCTTGAATTTAAAACCC | 51 | 1403 |
| 1042136 | N/A | N/A | 449764 | 449783 | GTGAAAGTTAAAATCTTGTT | 47 | 1404 |
| 1042168 | N/A | N/A | 450045 | 450064 | TGTTTCTTTTTGCCTAAATT | 13 | 1405 |
| 1042200 | N/A | N/A | 450734 | 450753 | TTTTCCTCTCACCAACCTCA | 67 | 1406 |
| 1042232 | N/A | N/A | 451491 | 451510 | ACTTTTAGAAACTAACTCTG | 71 | 1407 |
| 1042264 | N/A | N/A | 451796 | 451815 | GCCCTTTATAACAGGTACTA | 44 | 1408 |
| 1042296 | N/A | N/A | 452072 | 452091 | TGTGACATTCAGAAGACCAG | 27 | 1409 |
| 1042328 | N/A | N/A | 452405 | 452424 | TCAAAACTACATTTACATCA | 118 | 1410 |
| 1042360 | N/A | N/A | 452691 | 452710 | GGTTTAGGATTTTATCCCAG | 25 | 1411 |
| 1042392 | N/A | N/A | 453659 | 453678 | TGCATTATAGAAAATACTAA | 121 | 1412 |
| 1042424 | N/A | N/A | 454313 | 454332 | GGCAGATGAGAATTAAACTG | 38 | 1413 |

TABLE 19-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042456 | N/A | N/A | 455163 | 455182 | CAGGGCTTCTCATATAGAGT | 31 | 1414 |
| 1042488 | N/A | N/A | 455538 | 455557 | GGCACTTGAACATTCCAAAG | 10 | 1415 |
| 1042520 | N/A | N/A | 456757 | 456776 | GCTCACAAGCCCAGCGCGGT | 90 | 1416 |

TABLE 20

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040089 | 1170 | 1189 | 435889 | 435908 | TGTTGTAAACCAAGCTCCAC | 56 | 1417 |
| 1040121 | 2915 | 2934 | 457168 | 457187 | GTCCAAACACAAAAAAGGA | 90 | 1418 |
| 1040153 | 3475 | 3494 | 457728 | 457747 | TATTTTAGCCTACAGTACAG | 70 | 1419 |
| 1040185 | 4179 | 4198 | 458432 | 458451 | CCTGTCCACCACAACACCCT | 80 | 1420 |
| 1040217 | 4683 | 4702 | 458936 | 458955 | TCAGCAATTCTGCAGAGCTG | 103 | 1421 |
| 1040249 | 4953 | 4972 | 459206 | 459225 | AAGTTATAAACTCAATATGT | 38 | 1422 |
| 1040281 | 5348 | 5367 | 459601 | 459620 | TATGAAATACCCTTTCTGGG | 106 | 1423 |
| 1040313 | 5686 | 5705 | 459939 | 459958 | TCTAGCTATTCTAAACCTAT | 80 | 1424 |
| 1040345 | 6092 | 6111 | 460345 | 460364 | CCACAAAAATTATGATGATG | 45 | 1425 |
| 1040377 | 6871 | 6890 | 461124 | 461143 | CGAAGAATTTCTACCCCTGT | 47 | 1426 |
| 1040409 | 7338 | 7357 | 461591 | 461610 | TCATCCCAAACTAAACTGGG | 87 | 1427 |
| 1040441 | 7734 | 7753 | 461987 | 462006 | GCAACATATTTCAGTAAAGA | 13 | 1428 |
| 1040473 | 8203 | 8222 | 462456 | 462475 | CTTAAATTCTCTATTTCAGA | 30 | 1429 |
| 1040505 | 8506 | 8525 | 462759 | 462778 | GTGCTTCAAAATTTTGTTTT | 27 | 1430 |
| 1040537 | 8821 | 8840 | 463074 | 463093 | ACCGAGTTCCCCTCCCTCAG | 106 | 1431 |
| 1040569 | 9217 | 9236 | 463470 | 463489 | ACAGGAATACTATTCTGAGA | 38 | 1432 |
| 1040601 | 9550 | 9569 | 463803 | 463822 | GAAGCTCCAATGTATCTGC | 17 | 1433 |
| 1040633 | 10134 | 10153 | 464387 | 464406 | GGTGTCTGTTTTCCCTTGGC | 14 | 1434 |
| 1040665 | 10330 | 10349 | 464583 | 464602 | AAGTACAATATTTTACACTG | 20 | 1435 |
| 1040697 | N/A | N/A | 6321 | 6340 | GGCCATAAAATTGTAAACTG | 44 | 1436 |
| 1040729 | N/A | N/A | 23146 | 23165 | AACATCTAAATTTATAATGA | 113 | 1437 |
| 1040761 | N/A | N/A | 36881 | 36900 | AGGTGGTTACAAACATAAAT | 35 | 1438 |
| 1040793 | N/A | N/A | 63098 | 63117 | AGCTAAAAACCCAACATGGG | 81 | 1439 |
| 1040825 | N/A | N/A | 81039 | 81058 | GACAGTTATTTTAAGAGGC | 7 | 1440 |
| 1040857 | N/A | N/A | 103451 | 103470 | TTGGACTTTTAAATGTAAGT | 83 | 1441 |
| 1040889 | N/A | N/A | 135046 | 135065 | TGTGTCTAAATTTATGGTAG | 13 | 1442 |
| 1040921 | N/A | N/A | 160360 | 160379 | GTTGAATTTCAAAAATCAAA | 59 | 1443 |

TABLE 20-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040953 | N/A | N/A | 184290 | 184309 | CAGGAAAAAATACAGGGTGT | 19 | 1444 |
| 1040985 | N/A | N/A | 206209 | 206228 | ACCTAAAAAAATATAGATCC | 142 | 1445 |
| 1041017 | N/A | N/A | 223097 | 223116 | CTAATTAATCCTTAAATTGC | 109 | 1446 |
| 1041049 | N/A | N/A | 244961 | 244980 | TTTCAATATATTTACACACT | 63 | 1447 |
| 1041081 | N/A | N/A | 266459 | 266478 | CTCACACAAATTTACATTCT | 89 | 1448 |
| 1041113 | N/A | N/A | 284256 | 284275 | ACCTAAAAAATACATCTTTA | 94 | 1449 |
| 1041145 | N/A | N/A | 313344 | 313363 | CTGAAGATTCCTTAATATCT | 1 | 1450 |
| 1041177 | N/A | N/A | 331091 | 331110 | CTAATGTTTTAAAACTCTTG | 35 | 1451 |
| 1041209 | N/A | N/A | 355246 | 355265 | TTCCAATTTTAAAAAACCTG | 44 | 1452 |
| 1041241 | N/A | N/A | 376190 | 376209 | CTGTCAAAAATATAATACCT | 81 | 1453 |
| 1041273 | N/A | N/A | 401168 | 401187 | TGTCGCAAACCTTTATGGAG | 33 | 1454 |
| 1041305 | N/A | N/A | 432296 | 432315 | AAGTCCTTTCAAAGCCAAGT | 38 | 1455 |
| 1041337 | N/A | N/A | 437999 | 438018 | AGCATCTAATCCCCTCACTC | 42 | 1456 |
| 1041369 | N/A | N/A | 438464 | 438483 | AACCCGTTTACCCTGCCTCC | 77 | 1457 |
| 1041401 | N/A | N/A | 439004 | 439023 | GCCTGACTTTTATATGCAAA | 13 | 1458 |
| 1041433 | N/A | N/A | 439362 | 439381 | ACACTTGTAGAAAGTACGCT | 8 | 1459 |
| 1041465 | N/A | N/A | 440005 | 440024 | CTTCCAAAGACTGTAAACCT | 65 | 1460 |
| 1041497 | N/A | N/A | 440282 | 440301 | GCCTCTGTTCACAAAAATGT | 99 | 1461 |
| 1041529 | N/A | N/A | 440844 | 440863 | AAGCCAATTTCTCTTTCATT | 57 | 1462 |
| 1041561 | N/A | N/A | 441471 | 441490 | CACAACTTCCCCAATCAAAT | 70 | 1463 |
| 1041593 | N/A | N/A | 442076 | 442095 | CTCAAGAGATTATCTCCTAT | 30 | 1464 |
| 1041625 | N/A | N/A | 442399 | 442418 | ACAGGGATAGTGACAAACAC | 24 | 1465 |
| 1041657 | N/A | N/A | 442969 | 442988 | CTGTGAATCACTTTCTCAGG | 73 | 1466 |
| 1041689 | N/A | N/A | 443234 | 443253 | ACCCCTCAAATCCAGTTCAT | 129 | 1467 |
| 1041721 | N/A | N/A | 443723 | 443742 | GTAGACAGCCAGTAAGTACA | 62 | 1468 |
| 1041753 | N/A | N/A | 444096 | 444115 | ACCCACAAACAAAATGTGG | 132 | 1469 |
| 1041785 | N/A | N/A | 444648 | 444667 | CGCCAATGTGAAAAGGCGAC |  | 1470 |
| 1041817 | N/A | N/A | 445374 | 445393 | AGTGTTCTATTTAAAACACT | 131 | 1471 |
| 1041849 | N/A | N/A | 445708 | 445727 | CCAGACATACAAATTTCGCC | 40 | 1472 |
| 1041881 | N/A | N/A | 445955 | 445974 | AGTCAATAACTACTATATCT | 46 | 1473 |
| 1041913 | N/A | N/A | 446221 | 446240 | CCAGCAAGCCCATGTGCTCA | 109 | 1474 |
| 1041945 | N/A | N/A | 446792 | 446811 | AGTACCACAGATAACCAAAG | 52 | 1475 |
| 1041977 | N/A | N/A | 447180 | 447199 | CTGTATGGAAAACATTGCA | 29 | 1476 |
| 1042009 | N/A | N/A | 448133 | 448152 | ATGATGATCATTATGTAGAG | 24 | 1477 |
| 1042041 | N/A | N/A | 448619 | 448638 | AATGATACTATTTTTTACT | 77 | 1478 |
| 1042073 | N/A | N/A | 448923 | 448942 | GGAGACAGAACATACACGCA | 44 | 1479 |

TABLE 20-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042105 | N/A | N/A | 449439 | 449458 | TCTGTGAATTCCTTGAATTT | 41 | 1480 |
| 1042137 | N/A | N/A | 449765 | 449784 | GGTGAAAGTTAAAATCTTGT | 60 | 1481 |
| 1042169 | N/A | N/A | 450072 | 450091 | TCTTTAATCACTTCAAAGGC | 54 | 1482 |
| 1042201 | N/A | N/A | 450754 | 450773 | GGCTTTCCCAATAAACCTGC | 37 | 1483 |
| 1042233 | N/A | N/A | 451493 | 451512 | GTACTTTTAGAAACTAACTC | 47 | 1484 |
| 1042265 | N/A | N/A | 451798 | 451817 | AAGCCCTTTATAACAGGTAC | 38 | 1485 |
| 1042297 | N/A | N/A | 452094 | 452113 | GCCCAACACCAGGCAGAGGT | 82 | 1486 |
| 1042329 | N/A | N/A | 452407 | 452426 | TTTCAAAACTACATTTACAT | 117 | 1487 |
| 1042361 | N/A | N/A | 452759 | 452778 | TTGTAAATTTTACGAATAGT | 63 | 1488 |
| 1042393 | N/A | N/A | 453673 | 453692 | ACCATCAACAGATCTGCATT | 62 | 1489 |
| 1042425 | N/A | N/A | 454359 | 454378 | GCCTAGCCCCAAACAGGAAA | 117 | 1490 |
| 1042457 | N/A | N/A | 455172 | 455191 | AGGATGCACCAGGGCTTCTC | 79 | 1491 |
| 1042489 | N/A | N/A | 455557 | 455576 | GGGCCTGTTTTCTCCTGAAG | 116 | 1492 |
| 1042521 | N/A | N/A | 456758 | 456777 | GGCTCACAAGCCCAGCGCGG | 132 | 1493 |

TABLE 21

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040090 | 1171 | 1190 | 435890 | 435909 | CTGTTGTAAACCAAGCTCCA | 64 | 1494 |
| 1040122 | 2927 | 2946 | 457180 | 457199 | ATGACCAGCCCTGTCCAAAC | 73 | 1495 |
| 1040154 | 3482 | 3501 | 457735 | 457754 | ACTGTGTTATTTTAGCCTAC | 11 | 1496 |
| 1040186 | 4224 | 4243 | 458477 | 458496 | CCCAACCCCCCTTACCCCAT | 82 | 1497 |
| 1040218 | 4709 | 4728 | 458962 | 458981 | CATTGAAACTTTCAATATCT | 43 | 1498 |
| 1040250 | 4967 | 4986 | 459220 | 459239 | CAGGAATATCACACAAGTTA | 17 | 1499 |
| 1040282 | 5349 | 5368 | 459602 | 459621 | CTATGAAATACCCTTTCTGG | 79 | 1500 |
| 1040314 | 5687 | 5706 | 459940 | 459959 | TTCTAGCTATTCTAAACCTA | 75 | 1501 |
| 1040346 | 6094 | 6113 | 460347 | 460366 | AACCACAAAAATTATGATGA | 59 | 1502 |
| 1040378 | 6872 | 6891 | 461125 | 461144 | CCGAAGAATTTCTACCCCTG | 31 | 1503 |
| 1040410 | 7339 | 7358 | 461592 | 461611 | ATCATCCCAAACTAAACTGG | 71 | 1504 |
| 1040442 | 7739 | 7758 | 461992 | 462011 | TTTTGGCAACATATTTCAGT | 16 | 1505 |
| 1040474 | 8207 | 8226 | 462460 | 462479 | TGTTCTTAAATTCTCTATTT | 18 | 1506 |
| 1040506 | 8508 | 8527 | 462761 | 462780 | GAGTGCTTCAAAATTTTGTT | 20 | 1507 |
| 1040538 | 8843 | 8862 | 463096 | 463115 | CAGTATTCTCAAATCGCAGA | 58 | 1508 |
| 1040570 | 9219 | 9238 | 463472 | 463491 | GGACAGGAATACTATTCTGA | 45 | 1509 |

TABLE 21-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040602 | 9554 | 9573 | 463807 | 463826 | GGGTGAAGCCTCCAATGTAT | 29 | 1510 |
| 1040634 | 10151 | 10170 | 464404 | 464423 | CCCTCAACCCAAGTTCTGGT | 78 | 1511 |
| 1040666 | 10332 | 10351 | 464585 | 464604 | GCAAGTACAATATTTTACAC | 13 | 1512 |
| 1040698 | N/A | N/A | 6643 | 6662 | CACTGAAAAATATATGTTCA | 28 | 1513 |
| 1040730 | N/A | N/A | 23318 | 23337 | CACTATAAAAACATCTAACA | 98 | 1514 |
| 1040762 | N/A | N/A | 38292 | 38311 | TTCAACAATATTTATGCCCA | 5 | 1515 |
| 1040794 | N/A | N/A | 63099 | 63118 | CAGCTAAAAACCCAACATGG | 109 | 1516 |
| 1040826 | N/A | N/A | 81067 | 81086 | AGTTATATATTTTAGCTGAA | 58 | 1517 |
| 1040858 | N/A | N/A | 103630 | 103649 | GCTATATTTTAAAAGGATC | 89 | 1518 |
| 1040890 | N/A | N/A | 137052 | 137071 | CTTTCATTTCAAACTTACTG | 59 | 1519 |
| 1040922 | N/A | N/A | 161567 | 161586 | ACTTTCTTTTAAATTCTAAC | 69 | 1520 |
| 1040954 | N/A | N/A | 184602 | 184621 | GATGGTAATTTTTAGAGGTG | 4 | 1521 |
| 1040986 | N/A | N/A | 206522 | 206541 | TCTTTCTATATTTATCTATA | 51 | 1522 |
| 1041018 | N/A | N/A | 223242 | 223261 | GTTTACAAAATATTTGCACA | 37 | 1523 |
| 1041050 | N/A | N/A | 245286 | 245305 | TCTATCAAACCTAATCTATC | 53 | 1524 |
| 1041082 | N/A | N/A | 267260 | 267279 | AAGGAATTTCTTTACACCAT | 27 | 1525 |
| 1041114 | N/A | N/A | 284274 | 284293 | GCACTTCGAATTTATACCAC | 2 | 1526 |
| 1041146 | N/A | N/A | 314135 | 314154 | AACATAAAAATATACCTAA | 109 | 1527 |
| 1041178 | N/A | N/A | 331394 | 331413 | GCTGTTAAAATATGCTTTCC | 2 | 1528 |
| 1041210 | N/A | N/A | 356766 | 356785 | GGGCACTACCCTTATCTTAA | 38 | 1529 |
| 1041242 | N/A | N/A | 376191 | 376210 | CCTGTCAAAAATATAATACC | 89 | 1530 |
| 1041274 | N/A | N/A | 402544 | 402563 | CCTTTAAAAATATGCCTTTT | 46 | 1531 |
| 1041306 | N/A | N/A | 432451 | 432470 | CCAATAAAACCCCACAGGGT | 109 | 1532 |
| 1041338 | N/A | N/A | 438003 | 438022 | CTTTAGCATCTAATCCCCTC | 59 | 1533 |
| 1041370 | N/A | N/A | 438465 | 438484 | AAACCCGTTTACCCTGCCTC | 76 | 1534 |
| 1041402 | N/A | N/A | 439005 | 439024 | GGCCTGACTTTTATATGCAA | 117 | 1535 |
| 1041434 | N/A | N/A | 439383 | 439402 | GTTTTCAAATCCTAGATGGA | 26 | 1536 |
| 1041466 | N/A | N/A | 440010 | 440029 | GGGCCCTTCCAAAGACTGTA | 124 | 1537 |
| 1041498 | N/A | N/A | 440298 | 440317 | ACCTCTTTTCACACCTGCCT | 22 | 1538 |
| 1041530 | N/A | N/A | 440851 | 440870 | CACAGGGAAGCCAATTTCTC | 76 | 1539 |
| 1041562 | N/A | N/A | 441483 | 441502 | CATCTCTTCTTCCACAACTT | 52 | 1540 |
| 1041594 | N/A | N/A | 442078 | 442097 | CTCTCAAGAGATTATCTCCT | 104 | 1541 |
| 1041626 | N/A | N/A | 442489 | 442508 | CTTTCCTCCCACAGCACCTA | 49 | 1542 |
| 1041658 | N/A | N/A | 442983 | 443002 | GATTTATTTTCAGCTGTGA | 6 | 1543 |
| 1041690 | N/A | N/A | 443237 | 443256 | TGCACCCCTCAAATCCAGTT | 99 | 1544 |
| 1041722 | N/A | N/A | 443729 | 443748 | CCATCGGTAGACAGCCAGTA | 39 | 1545 |

TABLE 21-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041754 | N/A | N/A | 444105 | 444124 | GGTACAAAGACCCACAAACA | 51 | 1546 |
| 1041786 | N/A | N/A | 444737 | 444756 | AACATAATATTCAGTGCTAA | 40 | 1547 |
| 1041818 | N/A | N/A | 445375 | 445394 | GAGTGTTCTATTTAAAACAC | 82 | 1548 |
| 1041850 | N/A | N/A | 445710 | 445729 | TCCCAGACATACAAATTTCG | 90 | 1549 |
| 1041882 | N/A | N/A | 445956 | 445975 | TAGTCAATAACTACTATATC | 148 | 1550 |
| 1041914 | N/A | N/A | 446222 | 446241 | GCCAGCAAGCCCATGTGCTC | 121 | 1551 |
| 1041946 | N/A | N/A | 446793 | 446812 | CAGTACCACAGATAACCAAA | 30 | 1552 |
| 1041978 | N/A | N/A | 447541 | 447560 | GCTCAGTTAAAATCTGAAAG | 38 | 1553 |
| 1042010 | N/A | N/A | 448228 | 448247 | GTGGGCTCAAGATATCTTCC | 113 | 1554 |
| 1042042 | N/A | N/A | 448621 | 448640 | AGAATGATACTATTTTTTTA | 92 | 1555 |
| 1042074 | N/A | N/A | 448934 | 448953 | GCCTCCCACCAGGAGACAGA | 115 | 1556 |
| 1042106 | N/A | N/A | 449466 | 449485 | GATGTCATCTTCAACTGGAA | 28 | 1557 |
| 1042138 | N/A | N/A | 449771 | 449790 | TTCTTTGGTGAAAGTTAAAA | 91 | 1558 |
| 1042170 | N/A | N/A | 450076 | 450095 | TTCTTCTTTAATCACTTCAA | 35 | 1559 |
| 1042202 | N/A | N/A | 450757 | 450776 | TCTGGCTTTCCCAATAAACC | 62 | 1560 |
| 1042234 | N/A | N/A | 451505 | 451524 | AACAACAATCATGTACTTTT | 36 | 1561 |
| 1042266 | N/A | N/A | 451800 | 451819 | ACAAGCCCTTTATAACAGGT | 16 | 1562 |
| 1042298 | N/A | N/A | 452096 | 452115 | TTGCCCAACACCAGGCAGAG | 104 | 1563 |
| 1042330 | N/A | N/A | 452408 | 452427 | GTTTCAAAACTACATTTACA | 100 | 1564 |
| 1042362 | N/A | N/A | 452769 | 452788 | TCTTCCAATTTTGTAAATTT | 35 | 1565 |
| 1042394 | N/A | N/A | 453674 | 453693 | CACCATCAACAGATCTGCAT | 88 | 1566 |
| 1042426 | N/A | N/A | 454361 | 454380 | AGGCCTAGCCCCAAACAGGA | 145 | 1567 |
| 1042458 | N/A | N/A | 455185 | 455204 | CAGATCTTAAAAAAGGATGC | 59 | 1568 |
| 1042490 | N/A | N/A | 455600 | 455619 | ATCAGGAAAAGATGATGGCC | 111 | 1569 |
| 1042522 | N/A | N/A | 456802 | 456821 | AGAGCACCCACTTAGCTTTC | 98 | 1570 |

TABLE 22

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040091 | 1181 | 1200 | 435900 | 435919 | AACCTATTCCCTGTTGTAAA | 23 | 1571 |
| 1040123 | 2969 | 2988 | 457222 | 457241 | ACGGCAAATCAAAGAGCTGG | 130 | 1572 |
| 1040155 | 3517 | 3536 | 457770 | 457789 | ACAGAAACCTAAAATTAAGA | 116 | 1573 |
| 1040187 | 4227 | 4246 | 458480 | 458499 | ACCCCCAACCCCCCTTACCC | 102 | 1574 |
| 1040219 | 4720 | 4739 | 458973 | 458992 | CCTTTAAACCACATTGAAAC | 69 | 1575 |

TABLE 22-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040251 | 4968 | 4987 | 459221 | 459240 | GCAGGAATATCACACAAGTT | 14 | 1576 |
| 1040283 | 5351 | 5370 | 459604 | 459623 | AACTATGAAATACCCTTTCT | 130 | 1577 |
| 1040315 | 5696 | 5715 | 459949 | 459968 | AAGGAACTATTCTAGCTATT | 43 | 1578 |
| 1040347 | 6097 | 6116 | 460350 | 460369 | TAGAACCACAAAAATTATGA | 65 | 1579 |
| 1040379 | 6873 | 6892 | 461126 | 461145 | ACCGAAGAATTTCTACCCCT | 37 | 1580 |
| 1040411 | 7351 | 7370 | 461604 | 461623 | AACAGAAATCAAATCATCCC | 58 | 1581 |
| 1040443 | 7751 | 7770 | 462004 | 462023 | AACAAAAATAAATTTTGGCA | 103 | 1582 |
| 1040475 | 8210 | 8229 | 462463 | 462482 | ATGTGTTCTTAAATTCTCTA | 9 | 1583 |
| 1040507 | 8523 | 8542 | 462776 | 462795 | TGTACTCCTCAAAGTGAGTG | 126 | 1584 |
| 1040539 | 8844 | 8863 | 463097 | 463116 | ACAGTATTCTCAAATCGCAG | 67 | 1585 |
| 1040571 | 9251 | 9270 | 463504 | 463523 | CTGTCCAGTTTCCACTGTCC | 31 | 1586 |
| 1040603 | 9584 | 9603 | 463837 | 463856 | CAGCAAACAAACTAAAGGGA | 29 | 1587 |
| 1040635 | 10152 | 10171 | 464405 | 464424 | GCCCTCAACCCAAGTTCTGG | 129 | 1588 |
| 1040667 | 10375 | 10394 | 464628 | 464647 | TATGAATTCTTCCATTTTTT | 92 | 1589 |
| 1040699 | N/A | N/A | 7015 | 7034 | AACATTATTCAAAGAAATGT | 108 | 1590 |
| 1040731 | N/A | N/A | 24365 | 24384 | AGGCAGAACATTTAACATCG | 29 | 1591 |
| 1040763 | N/A | N/A | 38732 | 38751 | TCTGTGTTTATTTAGGTTTC | 3 | 1592 |
| 1040795 | N/A | N/A | 64787 | 64806 | ACTGCATTTCAAAACCTACA | 25 | 1593 |
| 1040827 | N/A | N/A | 81310 | 81329 | TTGAAGTTTTAAAGTACATG | 87 | 1594 |
| 1040859 | N/A | N/A | 105462 | 105481 | ATGTTTAAAATATGCATGCC | 152 | 1595 |
| 1040891 | N/A | N/A | 137270 | 137289 | TTTCTCAGAATATAACTGTA | 44 | 1596 |
| 1040923 | N/A | N/A | 162773 | 162792 | GTGTAATTTCAAAATAGGGT | 10 | 1597 |
| 1040955 | N/A | N/A | 185622 | 185641 | AGCTTTCAAATTTATCCACT | 9 | 1598 |
| 1040987 | N/A | N/A | 207222 | 207241 | ACTTAGCCAATTTAACTGCA | 26 | 1599 |
| 1041019 | N/A | N/A | 224367 | 224386 | TCTTTAAAACTATTAGTCAC | 81 | 1600 |
| 1041051 | N/A | N/A | 245290 | 245309 | CTAATCTATCAAACCTAATC | 142 | 1601 |
| 1041083 | N/A | N/A | 267301 | 267320 | TCAGTTAAAATACCTGATGA | 94 | 1602 |
| 1041115 | N/A | N/A | 284506 | 284525 | GGTTAATATTTTTATGGTAT | 1 | 1603 |
| 1041147 | N/A | N/A | 314443 | 314462 | GTTATAATTTAAAAGTGTT | 100 | 1604 |
| 1041179 | N/A | N/A | 332631 | 332650 | CCGTTTTATTTTTAAACTCG | 9 | 1605 |
| 1041211 | N/A | N/A | 356791 | 356810 | GCTTCATTTTAAAAGATTGT | 7 | 1606 |
| 1041243 | N/A | N/A | 376226 | 376245 | CCACATAAAATATCGAATCA | 40 | 1607 |
| 1041275 | N/A | N/A | 407589 | 407608 | CAGGGCTGTATTTAATTCTG | 14 | 1608 |
| 1041307 | N/A | N/A | 433208 | 433227 | GTTCTCAATCCTTAATGATT | 55 | 1609 |
| 1041339 | N/A | N/A | 438044 | 438063 | GACATATTTTAAAACATGGA | 13 | 1610 |
| 1041371 | N/A | N/A | 438475 | 438494 | AACCAATCCTAAACCCGTTT | 62 | 1611 |

TABLE 22-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041403 | N/A | N/A | 439006 | 439025 | AGGCCTGACTTTTATATGCA | 137 | 1612 |
| 1041435 | N/A | N/A | 439384 | 439403 | TGTTTTCAAATCCTAGATGG | 43 | 1613 |
| 1041467 | N/A | N/A | 440042 | 440061 | TTTTAAATAAGATCTTTGGG | 62 | 1614 |
| 1041499 | N/A | N/A | 440299 | 440318 | AACCTCTTTTCACACCTGCC | 26 | 1615 |
| 1041531 | N/A | N/A | 440909 | 440928 | AGTAGAGAGATTTAGTGATC | 16 | 1616 |
| 1041563 | N/A | N/A | 441492 | 441511 | GGAGAAAACCATCTCTTCTT | 76 | 1617 |
| 1041595 | N/A | N/A | 442096 | 442115 | GCATTAAAAAACGGAACCCT | 103 | 1618 |
| 1041627 | N/A | N/A | 442494 | 442513 | TTCCCCTTTCCTCCCACAGC | 99 | 1619 |
| 1041659 | N/A | N/A | 442984 | 443003 | TGATTTATTTTCAGCTGTG | 5 | 1620 |
| 1041691 | N/A | N/A | 443239 | 443258 | AATGCACCCCTCAAATCCAG | 109 | 1621 |
| 1041723 | N/A | N/A | 443762 | 443781 | AGTCAACCAAAAATAGTAG | 40 | 1622 |
| 1041755 | N/A | N/A | 444110 | 444129 | AGAGAGGTACAAAGACCCAC | 52 | 1623 |
| 1041787 | N/A | N/A | 444740 | 444759 | AACAACATAATATTCAGTGC | 27 | 1624 |
| 1041819 | N/A | N/A | 445394 | 445413 | TGAGTGTAAGAATCTCTGTG | 119 | 1625 |
| 1041851 | N/A | N/A | 445716 | 445735 | ACACTATCCCAGACATACAA | 57 | 1626 |
| 1041883 | N/A | N/A | 445961 | 445980 | CCACTTAGTCAATAACTACT | 34 | 1627 |
| 1041915 | N/A | N/A | 446223 | 446242 | TGCCAGCAAGCCCATGTGCT | 98 | 1628 |
| 1041947 | N/A | N/A | 446796 | 446815 | GAGCAGTACCACAGATAACC | 22 | 1629 |
| 1041979 | N/A | N/A | 447542 | 447561 | TGCTCAGTTAAAATCTGAAA | 49 | 1630 |
| 1042011 | N/A | N/A | 448333 | 448352 | CTCTAGTTTCCATAGCTTCC | 42 | 1631 |
| 1042043 | N/A | N/A | 448635 | 448654 | TTCCAAATACACCTAGAATG | 68 | 1632 |
| 1042075 | N/A | N/A | 448937 | 448956 | CTTGCCTCCCACCAGGAGAC | 100 | 1633 |
| 1042107 | N/A | N/A | 449467 | 449486 | TGATGTCATCTTCAACTGGA | 27 | 1634 |
| 1042139 | N/A | N/A | 449783 | 449802 | GGTTTTTTCCCTTCTTTGG | 8 | 1635 |
| 1042171 | N/A | N/A | 450078 | 450097 | GATTCTTCTTTAATCACTTC | 31 | 1636 |
| 1042203 | N/A | N/A | 450777 | 450796 | CTCATCATCTTCTCAATTTC | 86 | 1637 |
| 1042235 | N/A | N/A | 451509 | 451528 | CACAAACAACAATCATGTAC | 47 | 1638 |
| 1042267 | N/A | N/A | 451802 | 451821 | CTACAAGCCCTTTATAACAG | 26 | 1639 |
| 1042299 | N/A | N/A | 452101 | 452120 | TATTCTTGCCCAACACCAGG | 80 | 1640 |
| 1042331 | N/A | N/A | 452409 | 452428 | GGTTTCAAAACTACATTTAC | 58 | 1641 |
| 1042363 | N/A | N/A | 452840 | 452859 | TCTCAGGTACAAACTTTACA | 26 | 1642 |
| 1042395 | N/A | N/A | 453676 | 453695 | TTCACCATCAACAGATCTGC | 80 | 1643 |
| 1042427 | N/A | N/A | 454375 | 454394 | AGACAGTTTCAAGAAGGCCT | 111 | 1644 |
| 1042459 | N/A | N/A | 455186 | 455205 | TCAGATCTTAAAAAAGGATG | 102 | 1645 |
| 1042491 | N/A | N/A | 456123 | 456142 | AAGATAGTAAAAAGGCCAGG | 135 | 1646 |
| 1042523 | N/A | N/A | 456821 | 456840 | ATCGAACCCAGTAATGACA | 38 | 1647 |

TABLE 23

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040092 | 1188 | 1207 | 435907 | 435926 | TTGTGTAAACCTATTCCCTG | 17 | 1648 |
| 1040124 | 2971 | 2990 | 457224 | 457243 | ACACGGCAAATCAAAGAGCT | 93 | 1649 |
| 1040156 | 3526 | 3545 | 457779 | 457798 | AAGGTTAGAACAGAAACCTA | 94 | 1650 |
| 1040188 | 4228 | 4247 | 458481 | 458500 | CACCCCCAACCCCCCTTACC | 112 | 1651 |
| 1040220 | 4721 | 4740 | 458974 | 458993 | CCCTTTAAACCACATTGAAA | 59 | 1652 |
| 1040252 | 5005 | 5024 | 459258 | 459277 | CCCCAAACCTTTCCCACAAT | 53 | 1653 |
| 1040284 | 5387 | 5406 | 459640 | 459659 | ATGATATTTCGGATCTCTGG | 11 | 1654 |
| 1040316 | 5699 | 5718 | 459952 | 459971 | GTCAAGGAACTATTCTAGCT | 22 | 1655 |
| 1040348 | 6113 | 6132 | 460366 | 460385 | ATTCCTATACCTGAAATAGA | 51 | 1656 |
| 1040380 | 6874 | 6893 | 461127 | 461146 | CACCGAAGAATTTCTACCCC | 54 | 1657 |
| 1040412 | 7385 | 7404 | 461638 | 461657 | CTCACAATTCCAAGTTAGAA | 23 | 1658 |
| 1040444 | 7827 | 7846 | 462080 | 462099 | AGTAGTCACAGATGTTAAAG | 16 | 1659 |
| 1040476 | 8211 | 8230 | 462464 | 462483 | GATGTGTTCTTAAATTCTCT | 14 | 1660 |
| 1040508 | 8526 | 8545 | 462779 | 462798 | ACCTGTACTCCTCAAAGTGA | 58 | 1661 |
| 1040540 | 8845 | 8864 | 463098 | 463117 | AACAGTATTCTCAAATCGCA | 73 | 1662 |
| 1040572 | 9267 | 9286 | 463520 | 463539 | CTTAATATCCCCACAGCTGT | 108 | 1663 |
| 1040604 | 9597 | 9616 | 463850 | 463869 | TTGGCCATCCAGACAGCAAA | 96 | 1664 |
| 1040636 | 10153 | 10172 | 464406 | 464425 | TGCCCTCAACCCAAGTTCTG | 82 | 1665 |
| 1040668 | 10376 | 10395 | 464629 | 464648 | ATATGAATTCTTCCATTTTT | 91 | 1666 |
| 1040700 | N/A | N/A | 7886 | 7905 | CGTTATAAAATATATTACTA | 97 | 1667 |
| 1040732 | N/A | N/A | 24555 | 24574 | GCAAGATGAATTTATCCTCC | 11 | 1668 |
| 1040764 | N/A | N/A | 38983 | 39002 | CACAACTTATTTAATGTCA | 13 | 1669 |
| 1040796 | N/A | N/A | 66238 | 66257 | TGAGTATTTTAAACTCTTCT | 138 | 1670 |
| 1040828 | N/A | N/A | 83133 | 83152 | ATTCCATTATTTTAGAAAGC | 50 | 1671 |
| 1040860 | N/A | N/A | 105795 | 105814 | ACTTGCAAAATTTCAAGTTT | 131 | 1672 |
| 1040892 | N/A | N/A | 138729 | 138748 | AGCAAGTTAATTTATGGCCA | 101 | 1673 |
| 1040924 | N/A | N/A | 163155 | 163174 | GATTGAATCATTTACCTCGC | 49 | 1674 |
| 1040956 | N/A | N/A | 185759 | 185778 | ATCTGCTTTCTTTATTCCCT | 9 | 1675 |
| 1040988 | N/A | N/A | 207251 | 207270 | ATCTCTGTTATTTAACACTG | 70 | 1676 |
| 1041020 | N/A | N/A | 224368 | 224387 | TTCTTTAAAACTATTAGTCA | 122 | 1677 |
| 1041052 | N/A | N/A | 245320 | 245339 | GACCTCAAAACCAAATTAGG | 119 | 1678 |
| 1041084 | N/A | N/A | 268039 | 268058 | TCTGAAATTCAAAATCAGTG | 122 | 1679 |
| 1041116 | N/A | N/A | 284543 | 284562 | CCACTGGAAATTTAACATGA | 18 | 1680 |
| 1041148 | N/A | N/A | 315438 | 315457 | TGTATCACCCATTAACTGAC | 2 | 1681 |
| 1041180 | N/A | N/A | 332732 | 332751 | GACTAAAAAATATACATCTC | 57 | 1682 |
| 1041212 | N/A | N/A | 356967 | 356986 | GGTCTATTTCTTTACAGCAC | 2 | 1683 |

TABLE 23-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041244 | N/A | N/A | 376250 | 376269 | TTCTTCTGTATTTAATTCTT | 18 | 1684 |
| 1041276 | N/A | N/A | 407619 | 407638 | ACTGAGTTTCAAAGCAAAGA | 30 | 1685 |
| 1041308 | N/A | N/A | 433762 | 433781 | ATCCGATTTTAAAACAAACA | 64 | 1686 |
| 1041340 | N/A | N/A | 438045 | 438064 | AGACATATTTTAAAACATGG | 29 | 1687 |
| 1041372 | N/A | N/A | 438476 | 438495 | TAACCAATCCTAAACCCGTT | 97 | 1688 |
| 1041404 | N/A | N/A | 439022 | 439041 | ATTAGCTAATTCCTAGAGGC | 60 | 1689 |
| 1041436 | N/A | N/A | 439388 | 439407 | TGAATGTTTTCAAATCCTAG | 31 | 1690 |
| 1041468 | N/A | N/A | 440075 | 440094 | CCATTTATTTTAAAAATCCT | 69 | 1691 |
| 1041500 | N/A | N/A | 440312 | 440331 | CATTTCTAAACAAACCTCT | 95 | 1692 |
| 1041532 | N/A | N/A | 440910 | 440929 | CAGTAGAGAGATTTAGTGAT | 15 | 1693 |
| 1041564 | N/A | N/A | 441493 | 441512 | TGGAGAAAACCATCTCTTCT | 126 | 1694 |
| 1041596 | N/A | N/A | 442101 | 442120 | GTGAAGCATTAAAAAACGGA | 28 | 1695 |
| 1041628 | N/A | N/A | 442500 | 442519 | CTGGCATTCCCCTTTCCTCC | 92 | 1696 |
| 1041660 | N/A | N/A | 442985 | 443004 | TTGATTTATTTTCAGCTGT | 30 | 1697 |
| 1041692 | N/A | N/A | 443241 | 443260 | CCAATGCACCCCTCAAATCC | 147 | 1698 |
| 1041724 | N/A | N/A | 443784 | 443803 | CCGATGACTCACAGCTCACA | 46 | 1699 |
| 1041756 | N/A | N/A | 444141 | 444160 | GAGAGCATTTTTCTCCTTTT | 25 | 1700 |
| 1041788 | N/A | N/A | 444741 | 444760 | GAACAACATAATATTCAGTG | 10 | 1701 |
| 1041820 | N/A | N/A | 445425 | 445444 | TCATTAATAAAAACAGTCAA | 102 | 1702 |
| 1041852 | N/A | N/A | 445718 | 445737 | TGACACTATCCCAGACATAC | 34 | 1703 |
| 1041884 | N/A | N/A | 445963 | 445982 | CACCACTTAGTCAATAACTA | 38 | 1704 |
| 1041916 | N/A | N/A | 446261 | 446280 | CCACCCTCCTCCACTCTTTC | 138 | 1705 |
| 1041948 | N/A | N/A | 446798 | 446817 | GGGAGCAGTACCACAGATAA | 34 | 1706 |
| 1041980 | N/A | N/A | 447543 | 447562 | GTGCTCAGTTAAAATCTGAA | 29 | 1707 |
| 1042012 | N/A | N/A | 448335 | 448354 | CCCTCTAGTTTCCATAGCTT | 60 | 1708 |
| 1042044 | N/A | N/A | 448638 | 448657 | CTTTTCCAAATACACCTAGA | 46 | 1709 |
| 1042076 | N/A | N/A | 448955 | 448974 | TTGGTTAAGACCTAGTTTCT | 52 | 1710 |
| 1042108 | N/A | N/A | 449502 | 449521 | TGGATGTGAAACAGAGACGG | 17 | 1711 |
| 1042140 | N/A | N/A | 449787 | 449806 | ATAAGGTTTTTTCCCTTCT | 48 | 1712 |
| 1042172 | N/A | N/A | 450079 | 450098 | AGATTCTTCTTTAATCACTT | 39 | 1713 |
| 1042204 | N/A | N/A | 450800 | 450819 | GAGATGGTACTTTAGAAGGC | 14 | 1714 |
| 1042236 | N/A | N/A | 451510 | 451529 | ACACAAACAACAATCATGTA | 56 | 1715 |
| 1042268 | N/A | N/A | 451805 | 451824 | TGTCTACAAGCCCTTTATAA | 50 | 1716 |
| 1042300 | N/A | N/A | 452105 | 452124 | TGCTTATTCTTGCCCAACAC | 35 | 1717 |
| 1042332 | N/A | N/A | 452410 | 452429 | TGGTTTCAAAACTACATTTA | 105 | 1718 |
| 1042364 | N/A | N/A | 452899 | 452918 | GGCTATTTTTATAATGTGAA | 25 | 1719 |

TABLE 23-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042396 | N/A | N/A | 453692 | 453711 | ACAGTAATTAAAAGAATTCA | 88 | 1720 |
| 1042428 | N/A | N/A | 454436 | 454455 | CAGAAGTTAATACTTGAGGA | 71 | 1721 |
| 1042460 | N/A | N/A | 455194 | 455213 | GCAAAATATCAGATCTTAAA | 65 | 1722 |
| 1042492 | N/A | N/A | 456134 | 456153 | GGACAGCAAATAAGATAGTA | 48 | 1723 |
| 1042524 | N/A | N/A | 456828 | 456847 | CCAGTCAATCGAACCCCAGT | 85 | 1724 |

TABLE 24

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 1 | 138 |
| 1040093 | 1189 | 1208 | 435908 | 435927 | TTTGTGTAAACCTATTCCCT | 23 | 1725 |
| 1040125 | 2998 | 3017 | 457251 | 457270 | GCAGACATCCCCAACTGAGA | 41 | 1726 |
| 1040157 | 3559 | 3578 | 457812 | 457831 | CTCCTGCGACACACCTGCTG | 58 | 1727 |
| 1040189 | 4287 | 4306 | 458540 | 458559 | ATTGGTTTTCCTAACACTGC | 54 | 1728 |
| 1040221 | 4722 | 4741 | 458975 | 458994 | TCCCTTTAAACCACATTGAA | 65 | 1729 |
| 1040253 | 5006 | 5025 | 459259 | 459278 | CCCCCAAACCTTTCCCACAA | 61 | 1730 |
| 1040285 | 5394 | 5413 | 459647 | 459666 | CCCACAAATGATATTTCGGA | 20 | 1731 |
| 1040317 | 5719 | 5738 | 459972 | 459991 | GGTAATGAAATTCGAGGAAA | 12 | 1732 |
| 1040349 | 6120 | 6139 | 460373 | 460392 | TTTTATAATTCCTATACCTG | 61 | 1733 |
| 1040381 | 6876 | 6895 | 461129 | 461148 | GGCACCGAAGAATTTCTACC | 28 | 1734 |
| 1040413 | 7386 | 7405 | 461639 | 461658 | GCTCACAATTCCAAGTTAGA | 17 | 1735 |
| 1040445 | 7830 | 7849 | 462083 | 462102 | CTTAGTAGTCACAGATGTTA | 27 | 1736 |
| 1040477 | 8225 | 8244 | 462478 | 462497 | TATATTTATTACTTGATGTG | 24 | 1737 |
| 1040509 | 8541 | 8560 | 462794 | 462813 | ATTTTTTAAAACATTACCTG | 112 | 1738 |
| 1040541 | 8869 | 8888 | 463122 | 463141 | AGAAGTACTTTCAGCATAGG | 12 | 1739 |
| 1040573 | 9268 | 9287 | 463521 | 463540 | GCTTAATATCCCCACAGCTG | 120 | 1740 |
| 1040605 | 9624 | 9643 | 463877 | 463896 | TTGGCCACAGAAAAGGAGAC | 110 | 1741 |
| 1040637 | 10159 | 10178 | 464412 | 464431 | TGGTAGTGCCCTCAACCCAA | 43 | 1742 |
| 1040669 | 10394 | 10413 | 464647 | 464666 | CCACGATTAGAAAATAGAAT | 108 | 1743 |
| 1040701 | N/A | N/A | 8020 | 8039 | TCAAACAAAATATAATGCTT | 87 | 1744 |
| 1040733 | N/A | N/A | 24636 | 24655 | CTACACAAAACCAATCACTT | 78 | 1745 |
| 1040765 | N/A | N/A | 39292 | 39311 | CGCCTTAATTTTTATTATAG | 83 | 1746 |
| 1040797 | N/A | N/A | 66579 | 66598 | CCATTTAGAATATAGCTGTT | 25 | 1747 |
| 1040829 | N/A | N/A | 83570 | 83589 | ATTCTCATCCATTATACTTT | 48 | 1748 |
| 1040861 | N/A | N/A | 106210 | 106229 | TTACCAAAAACCATTTGTGT | 21 | 1749 |

TABLE 24 -continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040893 | N/A | N/A | 138831 | 138850 | TCCTTCTTTCAAAGTTCACC | 26 | 1750 |
| 1040925 | N/A | N/A | 163322 | 163341 | CTGCCACTATTTTATGTCTG | 59 | 1751 |
| 1040957 | N/A | N/A | 185775 | 185794 | CCCAGGTTCCCTTATCATCT | 19 | 1752 |
| 1040989 | N/A | N/A | 207430 | 207449 | TTCTGCAAATAATTCCGTCA | 23 | 1753 |
| 1041021 | N/A | N/A | 224375 | 224394 | CCATCATTTCTTTAAAACTA | 67 | 1754 |
| 1041053 | N/A | N/A | 246302 | 246321 | AAGTACATACAAATACATAT | 146 | 1755 |
| 1041085 | N/A | N/A | 268505 | 268524 | CCTATCAAAGCCACAACTTC | 117 | 1756 |
| 1041117 | N/A | N/A | 284846 | 284865 | TTGTATACCATTTATGTTTC | 2 | 1757 |
| 1041149 | N/A | N/A | 315942 | 315961 | CCACTCAAACCTTTCAATGC | 20 | 1758 |
| 1041181 | N/A | N/A | 334092 | 334111 | GAGCTCAAACCCAAGTCTGT | 72 | 1759 |
| 1041213 | N/A | N/A | 357527 | 357546 | ACCCTATTTCCTTAATGTAA | 41 | 1760 |
| 1041245 | N/A | N/A | 377993 | 378012 | CTCCTTCACCCTTAAGGCTA | 68 | 1761 |
| 1041277 | N/A | N/A | 409360 | 409379 | ATCGAGTCCTTTTAAACAAA | 19 | 1762 |
| 1041309 | N/A | N/A | 434288 | 434307 | ACAACTCGCCATTAACACTA | 65 | 1763 |
| 1041341 | N/A | N/A | 438053 | 438072 | AGCTAATAAGACATATTTTA | 109 | 1764 |
| 1041373 | N/A | N/A | 438477 | 438496 | CTAACCAATCCTAAACCCGT | 101 | 1765 |
| 1041405 | N/A | N/A | 439023 | 439042 | GATTAGCTAATTCCTAGAGG | 42 | 1766 |
| 1041437 | N/A | N/A | 439389 | 439408 | TTGAATGTTTTCAAATCCTA | 41 | 1767 |
| 1041469 | N/A | N/A | 440076 | 440095 | GCCATTTATTTTAAAAATCC | 10 | 1768 |
| 1041501 | N/A | N/A | 440313 | 440332 | GCATTTCTAAACAAAACCTC | 62 | 1769 |
| 1041533 | N/A | N/A | 441017 | 441036 | TGAGGAAGCCCTTCCCGGCA | 115 | 1770 |
| 1041565 | N/A | N/A | 441494 | 441513 | TTGGAGAAAACCATCTCTTC | 108 | 1771 |
| 1041597 | N/A | N/A | 442114 | 442133 | GGAAAGTATAAAAGTGAAGC | 25 | 1772 |
| 1041629 | N/A | N/A | 442524 | 442543 | GCACGCAGTAACAATGGACA | 31 | 1773 |
| 1041661 | N/A | N/A | 442987 | 443006 | CTTTGATTATTTTTCAGCT | 11 | 1774 |
| 1041693 | N/A | N/A | 443288 | 443307 | CCCTTGTTTCTGCATTGGTT | 46 | 1775 |
| 1041725 | N/A | N/A | 443792 | 443811 | TGTTACCACCGATGACTCAC | 42 | 1776 |
| 1041757 | N/A | N/A | 444158 | 444177 | GCACATACAGTTTAAAGGAG | 12 | 1777 |
| 1041789 | N/A | N/A | 444885 | 444904 | GGTCCCTGTTCCTAGGGAGG | 143 | 1778 |
| 1041821 | N/A | N/A | 445439 | 445458 | GCAATGTTTAAAAATCATTA | 71 | 1779 |
| 1041853 | N/A | N/A | 445722 | 445741 | TTCATGACACTATCCCAGAC | 46 | 1780 |
| 1041885 | N/A | N/A | 445968 | 445987 | CCTTTCACCACTTAGTCAAT | 33 | 1781 |
| 1041917 | N/A | N/A | 446266 | 446285 | GCCTCCCACCCTCCTCCACT | 101 | 1782 |
| 1041949 | N/A | N/A | 446814 | 446833 | ATGAAAATAAACTCATGGGA | 84 | 1783 |
| 1041981 | N/A | N/A | 447571 | 447590 | GTCTAAAGACTTCCTAGCA | 78 | 1784 |
| 1042013 | N/A | N/A | 448352 | 448371 | TCTATTTAAAATAACAACCC | 107 | 1785 |

TABLE 24 -continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042045 | N/A | N/A | 448641 | 448660 | TTCCTTTTCCAAATACACCT | 59 | 1786 |
| 1042077 | N/A | N/A | 448969 | 448988 | TAGAAGAGTATCTATTGGTT | 32 | 1787 |
| 1042109 | N/A | N/A | 449541 | 449560 | CATCTCAAAACATGCTGTCA | 86 | 1788 |
| 1042141 | N/A | N/A | 449797 | 449816 | GAGAAGTAAAATAAGGTTTT | 62 | 1789 |
| 1042173 | N/A | N/A | 450080 | 450099 | GAGATTCTTCTTTAATCACT | 27 | 1790 |
| 1042205 | N/A | N/A | 451120 | 451139 | GGAGATTTTACTTAATTTTT | 8 | 1791 |
| 1042237 | N/A | N/A | 451511 | 451530 | TACACAAACAACAATCATGT | 54 | 1792 |
| 1042269 | N/A | N/A | 451817 | 451836 | CTCATTAAGAAATGTCTACA | 69 | 1793 |
| 1042301 | N/A | N/A | 452128 | 452147 | GACTCTCTACCAGAGTTGCG | 102 | 1794 |
| 1042333 | N/A | N/A | 452413 | 452432 | ATTTGGTTTCAAAACTACAT | 91 | 1795 |
| 1042365 | N/A | N/A | 452900 | 452919 | GGGCTATTTTTATAATGTGA | 20 | 1796 |
| 1042397 | N/A | N/A | 453702 | 453721 | GTTCAGACAAACAGTAATTA | 18 | 1797 |
| 1042429 | N/A | N/A | 454481 | 454500 | ACATAATTTGAATCCTAGGA | 135 | 1798 |
| 1042461 | N/A | N/A | 455196 | 455215 | TAGCAAAATATCAGATCTTA | 41 | 1799 |
| 1042493 | N/A | N/A | 456136 | 456155 | CTGGACAGCAAATAAGATAG | 35 | 1800 |
| 1042525 | N/A | N/A | 456836 | 456855 | TGTTAGAACCAGTCAATCGA | 116 | 1801 |

TABLE 25

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040094 | 1212 | 1231 | 435931 | 435950 | TAGTCCAGCCCTGTGGACAA | 47 | 1802 |
| 1040126 | 2999 | 3018 | 457252 | 457271 | TGCAGACATCCCCAACTGAG | 57 | 1803 |
| 1040158 | 3572 | 3591 | 457825 | 457844 | CATATGCACCAGTCTCCTGC | 65 | 1804 |
| 1040190 | 4299 | 4318 | 458552 | 458571 | TGCAATAACCTGATTGGTTT | 39 | 1805 |
| 1040222 | 4725 | 4744 | 458978 | 458997 | TCATCCCTTTAAACCACATT | 35 | 1806 |
| 1040254 | 5007 | 5026 | 459260 | 459279 | TCCCCCAAACCTTTCCCACA | 94 | 1807 |
| 1040286 | 5401 | 5420 | 459654 | 459673 | TTCAAAACCCACAAATGATA | 88 | 1808 |
| 1040318 | 5721 | 5740 | 459974 | 459993 | AGGGTAATGAAATTCGAGGA | 10 | 1809 |
| 1040350 | 6122 | 6141 | 460375 | 460394 | TATTTTATAATTCCTATACC | 108 | 1810 |
| 1040382 | 6919 | 6938 | 461172 | 461191 | GGACATAGTACAGAGGCACA | 8 | 1811 |
| 1040414 | 7387 | 7406 | 461640 | 461659 | GGCTCACAATTCCAAGTTAG | 32 | 1812 |
| 1040446 | 7840 | 7859 | 462093 | 462112 | AATAGGTTTCCTTAGTAGTC | 22 | 1813 |
| 1040478 | 8227 | 8246 | 462480 | 462499 | TGTATATTATTACTTGATG | 10 | 1814 |
| 1040510 | 8546 | 8565 | 462799 | 462818 | GTGCAATTTTTTAAAACATT | 18 | 1815 |

TABLE 25-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040542 | 8907 | 8926 | 463160 | 463179 | GCAATGGCTTAAGAGTTTAG | 9 | 1816 |
| 1040574 | 9269 | 9288 | 463522 | 463541 | TGCTTAATATCCCCACAGCT | 91 | 1817 |
| 1040606 | 9636 | 9655 | 463889 | 463908 | AAGGCCTTCAGATTGGCCAC | 125 | 1818 |
| 1040638 | 10161 | 10180 | 464414 | 464433 | TCTGGTAGTGCCCTCAACCC | 45 | 1819 |
| 1040670 | 10402 | 10421 | 464655 | 464674 | TAGACACACCACGATTAGAA | 68 | 1820 |
| 1040702 | N/A | N/A | 8570 | 8589 | ACTCAATATTTTAAAACCC | 28 | 1821 |
| 1040734 | N/A | N/A | 25367 | 25386 | GACTGAATTATTTATAGTTG | 42 | 1822 |
| 1040766 | N/A | N/A | 40104 | 40123 | ATGCAATTTTAAATTCATGT | 18 | 1823 |
| 1040798 | N/A | N/A | 66787 | 66806 | GGGAAAATTCCTTAGCATAT | 30 | 1824 |
| 1040830 | N/A | N/A | 83587 | 83606 | GCTGAGTTCCAAAGCAAATT | 35 | 1825 |
| 1040862 | N/A | N/A | 106215 | 106234 | ATGACTTACCAAAAACCATT | 105 | 1826 |
| 1040894 | N/A | N/A | 139215 | 139234 | AGGGCTTAAATTTAACTGAA | 28 | 1827 |
| 1040926 | N/A | N/A | 163369 | 163388 | AACGAAATTCCTTAAGGACA | 62 | 1828 |
| 1040958 | N/A | N/A | 185909 | 185928 | TTGGTTCTATTTTATAATAG | 66 | 1829 |
| 1040990 | N/A | N/A | 207479 | 207498 | AGACTACTATTTTATCACTG | 19 | 1830 |
| 1041022 | N/A | N/A | 225966 | 225985 | TCACTTAAACCCAGGTCAGC | 81 | 1831 |
| 1041054 | N/A | N/A | 247054 | 247073 | TTCCCCAAAATTTAGTTGTG | 85 | 1832 |
| 1041086 | N/A | N/A | 268668 | 268687 | CTTCAACTATTTTATTTGGC | 30 | 1833 |
| 1041118 | N/A | N/A | 284950 | 284969 | AGTAGAATTTAAAAGTAGAA | 110 | 1834 |
| 1041150 | N/A | N/A | 316219 | 316238 | GGATTTCTAATTTAATCTTT | 37 | 1835 |
| 1041182 | N/A | N/A | 334729 | 334748 | TAGTTCTTTCAAACTCCTTT | 2 | 1836 |
| 1041214 | N/A | N/A | 358497 | 358516 | GCTATAATTCAAAATGCTCT | 115 | 1837 |
| 1041246 | N/A | N/A | 380363 | 380382 | GCCTAAACAATTTATTCATT | 31 | 1838 |
| 1041278 | N/A | N/A | 409434 | 409453 | ACCCTTCTATTTTATAAAGC | 69 | 1839 |
| 1041310 | N/A | N/A | 434517 | 434536 | TGCAAGTTTCAAAAGAATTC | 133 | 1840 |
| 1041342 | N/A | N/A | 438074 | 438093 | AAGGCATATACCACTGTACC | 61 | 1841 |
| 1041374 | N/A | N/A | 438478 | 438497 | TCTAACCAATCCTAAACCCG | 107 | 1842 |
| 1041406 | N/A | N/A | 439043 | 439062 | AGAGGTATAGTCTCTCCTAG | 29 | 1843 |
| 1041438 | N/A | N/A | 439430 | 439449 | TGACTATTTTCAACTCAAGC | 16 | 1844 |
| 1041470 | N/A | N/A | 440085 | 440104 | TATTATTATGCCATTTATTT | 41 | 1845 |
| 1041502 | N/A | N/A | 440315 | 440334 | TCGCATTTCTAAACAAAACC | 52 | 1846 |
| 1041534 | N/A | N/A | 441019 | 441038 | TTTGAGGAAGCCCTTCCCGG | 119 | 1847 |
| 1041566 | N/A | N/A | 441497 | 441516 | GTTTTGGAGAAAACCATCTC | 69 | 1848 |
| 1041598 | N/A | N/A | 442146 | 442165 | CTAATAAATTTTTACAAGGG | 72 | 1849 |
| 1041630 | N/A | N/A | 442542 | 442561 | AAGGAGGCTTCCTTTGGTGC | 70 | 1850 |
| 1041662 | N/A | N/A | 442991 | 443010 | AGGCCTTTGATTTATTTTTC | 110 | 1851 |

TABLE 25-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041694 | N/A | N/A | 443385 | 443404 | GATGGAAGCCAAAGGCTCCC | 115 | 1852 |
| 1041726 | N/A | N/A | 443794 | 443813 | AATGTTACCACCGATGACTC | 71 | 1853 |
| 1041758 | N/A | N/A | 444206 | 444225 | TCTGAGAGAATCAAAACATA | 29 | 1854 |
| 1041790 | N/A | N/A | 445090 | 445109 | CTCACTTGCCTTCCTTTTCT | 46 | 1855 |
| 1041822 | N/A | N/A | 445440 | 445459 | TGCAATGTTTAAAAATCATT | 94 | 1856 |
| 1041854 | N/A | N/A | 445730 | 445749 | AACATTTTTTCATGACACTA | 10 | 1857 |
| 1041886 | N/A | N/A | 445969 | 445988 | TCCTTTCACCACTTAGTCAA | 47 | 1858 |
| 1041918 | N/A | N/A | 446324 | 446343 | TCTGTCTTTCATCTCTGGAT | 44 | 1859 |
| 1041950 | N/A | N/A | 446817 | 446836 | CCAATGAAAATAAACTCATG | 98 | 1860 |
| 1041982 | N/A | N/A | 447576 | 447595 | CCAGAGTCTAAAAGACTTCC | 110 | 1861 |
| 1042014 | N/A | N/A | 448353 | 448372 | TTCTATTTAAAATAACAACC | 116 | 1862 |
| 1042046 | N/A | N/A | 448648 | 448667 | GTATGGGTTCCTTTTCCAAA | 7 | 1863 |
| 1042078 | N/A | N/A | 449026 | 449045 | AGTTTTAATAAAGTTCAAC | 96 | 1864 |
| 1042110 | N/A | N/A | 449542 | 449561 | CCATCTCAAAACATGCTGTC | 78 | 1865 |
| 1042142 | N/A | N/A | 449830 | 449849 | ATGTACTTTTCCCCCTTGG | 65 | 1866 |
| 1042174 | N/A | N/A | 450083 | 450102 | TGGGAGATTCTTCTTTAATC | 19 | 1867 |
| 1042206 | N/A | N/A | 451121 | 451140 | TGGAGATTTTACTTAATTTT | 33 | 1868 |
| 1042238 | N/A | N/A | 451518 | 451537 | GATAATATACACAAACAACA | 86 | 1869 |
| 1042270 | N/A | N/A | 451821 | 451840 | TAGACTCATTAAGAAATGTC | 91 | 1870 |
| 1042302 | N/A | N/A | 452129 | 452148 | AGACTCTCTACCAGAGTTGC | 100 | 1871 |
| 1042334 | N/A | N/A | 452424 | 452443 | TGTGTGACACTATTTGGTTT | 74 | 1872 |
| 1042366 | N/A | N/A | 452902 | 452921 | CTGGGCTATTTTTATAATGT | 30 | 1873 |
| 1042398 | N/A | N/A | 453708 | 453727 | AGACATGTTCAGACAAACAG | 58 | 1874 |
| 1042430 | N/A | N/A | 454483 | 454502 | ACACATAATTTGAATCCTAG | 110 | 1875 |
| 1042462 | N/A | N/A | 455198 | 455217 | ACTAGCAAAATATCAGATCT | 49 | 1876 |
| 1042494 | N/A | N/A | 456154 | 456173 | ACTTTTTTCTTATAGTACT | 68 | 1877 |
| 1042526 | N/A | N/A | 456838 | 456857 | TCTGTTAGAACCAGTCAATC | 51 | 1878 |

TABLE 26

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040095 | 1514 | 1533 | 436233 | 436252 | TCAGACTGCCCATGTTGGCC | 71 | 1879 |
| 1040127 | 3033 | 3052 | 457286 | 457305 | GAGCCGTTCTTCAGGTTCTT | 93 | 1880 |
| 1040159 | 3643 | 3662 | 457896 | 457915 | GCCTGGAGCCCTGACCGCTC | 60 | 1881 |

TABLE 26-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040191 | 4300 | 4319 | 458553 | 458572 | ATGCAATAACCTGATTGGTT | 16 | 1882 |
| 1040223 | 4727 | 4746 | 458980 | 458999 | ATTCATCCCTTTAAACCACA | 15 | 1883 |
| 1040255 | 5011 | 5030 | 459264 | 459283 | TCAGTCCCCCAAACCTTTCC | 20 | 1884 |
| 1040287 | 5407 | 5426 | 459660 | 459679 | GATGCATTCAAAACCCACAA | 21 | 1885 |
| 1040319 | 5766 | 5785 | 460019 | 460038 | TGACTGCAAGAATGAGCCCA | 60 | 1886 |
| 1040351 | 6126 | 6145 | 460379 | 460398 | CAATTATTTTATAATTCCTA | 82 | 1887 |
| 1040383 | 6921 | 6940 | 461174 | 461193 | GTGGACATAGTACAGAGGCA | 7 | 1888 |
| 1040415 | 7388 | 7407 | 461641 | 461660 | AGGCTCACAATTCCAAGTTA | 26 | 1889 |
| 1040447 | 7865 | 7884 | 462118 | 462137 | TGGAGATTTTCTCTCTATG | 36 | 1890 |
| 1040479 | 8228 | 8247 | 462481 | 462500 | CTGTATATTTATTACTTGAT | 7 | 1891 |
| 1040511 | 8566 | 8585 | 462819 | 462838 | TCGACATTCATTTTTCTTTT | 10 | 1892 |
| 1040543 | 8940 | 8959 | 463193 | 463212 | ATGTCAAACATCATCTCTGA | 12 | 1893 |
| 1040575 | 9272 | 9291 | 463525 | 463544 | GGGTGCTTAATATCCCCACA | 115 | 1894 |
| 1040607 | 9637 | 9656 | 463890 | 463909 | GAAGGCCTTCAGATTGGCCA | 101 | 1895 |
| 1040639 | 10163 | 10182 | 464416 | 464435 | AGTCTGGTAGTGCCCTCAAC | 17 | 1896 |
| 1040671 | 10407 | 10426 | 464660 | 464679 | ACAAATAGACACACCACGAT | 77 | 1897 |
| 1040703 | N/A | N/A | 9147 | 9166 | GTTGAGTTACAAATATAAAT | 70 | 1898 |
| 1040735 | N/A | N/A | 25394 | 25413 | CCAGGATTTTAAAAAAGCA | 15 | 1899 |
| 1040767 | N/A | N/A | 40413 | 40432 | GCTAAATTTCCTTAAGCTTT | 42 | 1900 |
| 1040799 | N/A | N/A | 70441 | 70460 | CATCAGTTCCAAAACCTGGA | 83 | 1901 |
| 1040831 | N/A | N/A | 83929 | 83948 | CCAATACACCTTTATTTTTC | 22 | 1902 |
| 1040863 | N/A | N/A | 106559 | 106578 | CGATTAATCCCTTATGTTTT | 4 | 1903 |
| 1040895 | N/A | N/A | 140193 | 140212 | CTCTTCAAAAACATATCCGA | 55 | 1904 |
| 1040927 | N/A | N/A | 163438 | 163457 | TTCTAAATTTAAAACTCCAA | 101 | 1905 |
| 1040959 | N/A | N/A | 186773 | 186792 | ACAGGCAATATTTACTATAA | 1 | 1906 |
| 1040991 | N/A | N/A | 207544 | 207563 | GCCTTCTTCCTTTATAGCAC | 32 | 1907 |
| 1041023 | N/A | N/A | 227246 | 227265 | TTAGGCTATTAAATAATAGA | 124 | 1908 |
| 1041055 | N/A | N/A | 247203 | 247222 | CTCAGTATCTTTTAATTGCC | 29 | 1909 |
| 1041087 | N/A | N/A | 269929 | 269948 | TGGGCCAAAACACCCCTTT | 95 | 1910 |
| 1041119 | N/A | N/A | 284975 | 284994 | CTGTTTAAAAATGTATTGAG | 23 | 1911 |
| 1041151 | N/A | N/A | 316940 | 316959 | GTCCCTTATCCTTAACACAC | 2 | 1912 |
| 1041183 | N/A | N/A | 334783 | 334802 | CCCTAAATTTAAATTCTCTG | 62 | 1913 |
| 1041215 | N/A | N/A | 358611 | 358630 | ACCTTTATTTAAATTTTCCA | 22 | 1914 |
| 1041247 | N/A | N/A | 380517 | 380536 | GCTCAATATATTTATCTATT | 1 | 1915 |
| 1041279 | N/A | N/A | 410051 | 410070 | TCTGTATTTTAAAAATCTCT | 27 | 1916 |
| 1041311 | N/A | N/A | 437693 | 437712 | CGAGAACCCTTAATCCTGCC | 34 | 1917 |

TABLE 26-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041343 | N/A | N/A | 438076 | 438095 | CGAAGGCATATACCACTGTA | 48 | 1918 |
| 1041375 | N/A | N/A | 438482 | 438501 | CCACTCTAACCAATCCTAAA | 48 | 1919 |
| 1041407 | N/A | N/A | 439087 | 439106 | TTTTATTTTCTGATGCTTTG | 10 | 1920 |
| 1041439 | N/A | N/A | 439432 | 439451 | CATGACTATTTTCAACTCAA | 4 | 1921 |
| 1041471 | N/A | N/A | 440089 | 440108 | GCTGTATTATTATGCCATTT | 12 | 1922 |
| 1041503 | N/A | N/A | 440316 | 440335 | GTCGCATTTCTAAACAAAAC | 64 | 1923 |
| 1041535 | N/A | N/A | 441116 | 441135 | AGTGACAAATCATTGGTTGC | 28 | 1924 |
| 1041567 | N/A | N/A | 441513 | 441532 | AGTCACAATGCCATCTGTTT | 10 | 1925 |
| 1041599 | N/A | N/A | 442147 | 442166 | GCTAATAAATTTTTACAAGG | 56 | 1926 |
| 1041631 | N/A | N/A | 442566 | 442585 | TGCTATCACCCTCCACTGAA | 85 | 1927 |
| 1041663 | N/A | N/A | 443017 | 443036 | CTTCCATAAACTCTTTTTAG | 45 | 1928 |
| 1041695 | N/A | N/A | 443387 | 443406 | CAGATGGAAGCCAAAGGCTC | 117 | 1929 |
| 1041727 | N/A | N/A | 443815 | 443834 | CAGCTAATCCATTCAATGCA | 60 | 1930 |
| 1041759 | N/A | N/A | 444223 | 444242 | GCTATAAACAACAACAGTCT | 26 | 1931 |
| 1041791 | N/A | N/A | 445120 | 445139 | CACGGAAGCCCTTAGGCACA | 63 | 1932 |
| 1041823 | N/A | N/A | 445455 | 445474 | GAGAGACCCATTTACTGCAA | 8 | 1933 |
| 1041855 | N/A | N/A | 445739 | 445758 | GTTTTACAAAACATTTTTTC | 56 | 1934 |
| 1041887 | N/A | N/A | 445972 | 445991 | AATTCCTTTCACCACTTAGT | 16 | 1935 |
| 1041919 | N/A | N/A | 446325 | 446344 | CTCTGTCTTTCATCTCTGGA | 49 | 1936 |
| 1041951 | N/A | N/A | 446818 | 446837 | CCCAATGAAAATAAACTCAT | 77 | 1937 |
| 1041983 | N/A | N/A | 447604 | 447623 | CTCTTTCCCCAAACTCAGTG | 30 | 1938 |
| 1042015 | N/A | N/A | 448354 | 448373 | GTTCTATTTAAAATAACAAC | 109 | 1939 |
| 1042047 | N/A | N/A | 448660 | 448679 | TATAAGCAAACTGTATGGGT | 13 | 1940 |
| 1042079 | N/A | N/A | 449037 | 449056 | TCAGGCTTTCCAGTTTTAAT | 16 | 1941 |
| 1042111 | N/A | N/A | 449544 | 449563 | CTCCATCTCAAAACATGCTG | 82 | 1942 |
| 1042143 | N/A | N/A | 449832 | 449851 | CAATGTACTTTTTCCCCCTT | 32 | 1943 |
| 1042175 | N/A | N/A | 450112 | 450131 | AATGAAATTTATGTTAACCT | 75 | 1944 |
| 1042207 | N/A | N/A | 451122 | 451141 | TTGGAGATTTTACTTAATTT | 30 | 1945 |
| 1042239 | N/A | N/A | 451523 | 451542 | ACCGAGATAATATACACAAA | 5 | 1946 |
| 1042271 | N/A | N/A | 451863 | 451882 | TAGGTAAACTTATCTGAGGA | 15 | 1947 |
| 1042303 | N/A | N/A | 452153 | 452172 | TCAGGTGTTAACATCTGTCT | 99 | 1948 |
| 1042335 | N/A | N/A | 452453 | 452472 | CTCATACAATTCTAGTTACC | 45 | 1949 |
| 1042367 | N/A | N/A | 452919 | 452938 | GGGAAAGTTTCATTGTTCTG | 24 | 1950 |
| 1042399 | N/A | N/A | 453742 | 453761 | GCAAAAGATCCTTCCAGAA | 62 | 1951 |
| 1042431 | N/A | N/A | 454491 | 454510 | GCTAACAGACACATAATTTG | 111 | 1952 |

TABLE 26-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042463 | N/A | N/A | 455199 | 455218 | CACTAGCAAAATATCAGATC | 54 | 1953 |
| 1042495 | N/A | N/A | 456155 | 456174 | AACTTTTTTCTTATAGTAC | 66 | 1954 |
| 1042527 | N/A | N/A | 456877 | 456896 | TTCAAAATATTCCATCAAGT | 25 | 1955 |

TABLE 27

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 1 | 138 |
| 1040096 | 1932 | 1951 | 436651 | 436670 | TCACCGTTCAGGACCTCCTT | 70 | 1956 |
| 1040128 | 3046 | 3065 | 457299 | 457318 | GCCCTTTTTAACAGAGCCGT | 122 | 1957 |
| 1040160 | 3669 | 3688 | 457922 | 457941 | GCCCCGTTCCTTTCTTCCCC | 67 | 1958 |
| 1040192 | 4313 | 4332 | 458566 | 458585 | GGGAGTGAAGTCAATGCAAT | 17 | 1959 |
| 1040224 | 4728 | 4747 | 458981 | 459000 | CATTCATCCCTTTAAACCAC | 22 | 1960 |
| 1040256 | 5013 | 5032 | 459266 | 459285 | GTTCAGTCCCCCAAACCTTT | 16 | 1961 |
| 1040288 | 5408 | 5427 | 459661 | 459680 | AGATGCATTCAAAACCCACA | 21 | 1962 |
| 1040320 | 5785 | 5804 | 460038 | 460057 | CAGCACTAAATAAGCAGTAT | 11 | 1963 |
| 1040352 | 6128 | 6147 | 460381 | 460400 | ACCAATTATTTTATAATTCC | 59 | 1964 |
| 1040384 | 6941 | 6960 | 461194 | 461213 | CTGTCGGTAAATATTGCAAA | 10 | 1965 |
| 1040416 | 7404 | 7423 | 461657 | 461676 | CTAACAGAAAACATAGAGGC | 28 | 1966 |
| 1040448 | 7866 | 7885 | 462119 | 462138 | TTGGAGATTTTTCTCTCTAT | 54 | 1967 |
| 1040480 | 8229 | 8248 | 462482 | 462501 | TCTGTATATTTATTACTTGA | 10 | 1968 |
| 1040512 | 8597 | 8616 | 462850 | 462869 | GCCATATCTTTCAAACACTG | 8 | 1969 |
| 1040544 | 8941 | 8960 | 463194 | 463213 | AATGTCAAACATCATCTCTG | 13 | 1970 |
| 1040576 | 9292 | 9311 | 463545 | 463564 | AATTTAAGAATTGTAAGTGG | 123 | 1971 |
| 1040608 | 9640 | 9659 | 463893 | 463912 | AACGAAGGCCTTCAGATTGG | 107 | 1972 |
| 1040640 | 10189 | 10208 | 464442 | 464461 | TAGTTCTCCTCTGTACTGGC | 14 | 1973 |
| 1040672 | 10409 | 10428 | 464662 | 464681 | CTACAAATAGACACACCACG | 70 | 1974 |
| 1040704 | N/A | N/A | 9365 | 9384 | AACAGTAGCCAAAATGTTCT | 100 | 1975 |
| 1040736 | N/A | N/A | 25410 | 25429 | CTAGAATTTTAAAAAACCAG | 80 | 1976 |
| 1040768 | N/A | N/A | 40502 | 40521 | AGTACAATCTTTTATAGATA | 89 | 1977 |
| 1040800 | N/A | N/A | 70463 | 70482 | TGCCTGAGAATTTAATACTA | 72 | 1978 |
| 1040832 | N/A | N/A | 84147 | 84166 | AGTAAGCTTCTTTAACTTTA | 11 | 1979 |
| 1040864 | N/A | N/A | 107690 | 107709 | TGGATAATTATTTAATTCAT | 70 | 1980 |
| 1040896 | N/A | N/A | 140329 | 140348 | CCAAACTAAGAATAATCTAG | 89 | 1981 |
| 1040928 | N/A | N/A | 165500 | 165519 | GAGGAAATTATTTACTGGCT | 5 | 1982 |

TABLE 27-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040960 | N/A | N/A | 187228 | 187247 | ATGCACATACAAATAAGCTC | 51 | 1983 |
| 1040992 | N/A | N/A | 207564 | 207583 | GAGATTAAAATACAATTGCT | 36 | 1984 |
| 1041024 | N/A | N/A | 227353 | 227372 | GATTTCTCCTTTTAACCTCT | 23 | 1985 |
| 1041056 | N/A | N/A | 248796 | 248815 | TTCTCAAAACCTTATCTCCT | 92 | 1986 |
| 1041088 | N/A | N/A | 270452 | 270471 | CATTTTATTCCTTATCCTAC | 118 | 1987 |
| 1041120 | N/A | N/A | 285644 | 285663 | CATTTGCACCTTTAATTTGT | 24 | 1988 |
| 1041152 | N/A | N/A | 316955 | 316974 | TTCCAAAAGAATGTGTCCC | 16 | 1989 |
| 1041184 | N/A | N/A | 335393 | 335412 | GGTAGCTATCATTATTAAGC | 19 | 1990 |
| 1041216 | N/A | N/A | 358821 | 358840 | CGACAGAAAATATATCTGCT | 47 | 1991 |
| 1041248 | N/A | N/A | 382312 | 382331 | GACTGCAAAATTCCCATTGC | 28 | 1992 |
| 1041280 | N/A | N/A | 410115 | 410134 | CTGTAAAAATACACATCCTC | 38 | 1993 |
| 1041312 | N/A | N/A | 437695 | 437714 | CCCGAGAACCCTTAATCCTG | 37 | 1994 |
| 1041344 | N/A | N/A | 438160 | 438179 | CACAGGTTCAGCCATAGCTC | 21 | 1995 |
| 1041376 | N/A | N/A | 438483 | 438502 | TCCACTCTAACCAATCCTAA | 66 | 1996 |
| 1041408 | N/A | N/A | 439090 | 439109 | CGCTTTTATTTTCTGATGCT | 20 | 1997 |
| 1041440 | N/A | N/A | 439433 | 439452 | TCATGACTATTTTCAACTCA | 18 | 1998 |
| 1041472 | N/A | N/A | 440090 | 440109 | AGCTGTATTATTATGCCATT | 43 | 1999 |
| 1041504 | N/A | N/A | 440317 | 440336 | AGTCGCATTTCTAAACAAAA | 66 | 2000 |
| 1041536 | N/A | N/A | 441117 | 441136 | AAGTGACAAATCATTGGTTG | 21 | 2001 |
| 1041568 | N/A | N/A | 441519 | 441538 | GCCTAGAGTCACAATGCCAT | 33 | 2002 |
| 1041600 | N/A | N/A | 442148 | 442167 | CGCTAATAAATTTTTACAAG | 91 | 2003 |
| 1041632 | N/A | N/A | 442620 | 442639 | TCAACCAGAATCAAGGCATG | 66 | 2004 |
| 1041664 | N/A | N/A | 443022 | 443041 | CTCTCCTTCCATAAACTCTT | 69 | 2005 |
| 1041696 | N/A | N/A | 443410 | 443429 | GATGGGATAATATAGAACGC | 45 | 2006 |
| 1041728 | N/A | N/A | 443816 | 443835 | CCAGCTAATCCATTCAATGC | 34 | 2007 |
| 1041760 | N/A | N/A | 444225 | 444244 | ATGCTATAAACAACAACAGT | 47 | 2008 |
| 1041792 | N/A | N/A | 445122 | 445141 | GACACGGAAGCCCTTAGGCA | 46 | 2009 |
| 1041824 | N/A | N/A | 445457 | 445476 | GCGAGAGACCCATTTACTGC | 11 | 2010 |
| 1041856 | N/A | N/A | 445746 | 445765 | GGCATCTGTTTTACAAAACA | 9 | 2011 |
| 1041888 | N/A | N/A | 445977 | 445996 | AATAAAATTCCTTTCACCAC | 35 | 2012 |
| 1041920 | N/A | N/A | 446352 | 446371 | CTTTATACTTTTGTAAGCTT | 29 | 2013 |
| 1041952 | N/A | N/A | 446819 | 446838 | TCCCAATGAAAATAAACTCA | 108 | 2014 |
| 1041984 | N/A | N/A | 447606 | 447625 | GCCTCTTTCCCCAAACTCAG | 29 | 2015 |
| 1042016 | N/A | N/A | 448356 | 448375 | CAGTTCTATTTAAAATAACA | 117 | 2016 |
| 1042048 | N/A | N/A | 448668 | 448687 | ATCCCAATTATAAGCAAACT | 64 | 2017 |
| 1042080 | N/A | N/A | 449039 | 449058 | TTTCAGGCTTTCCAGTTTTA | 20 | 2018 |

TABLE 27-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042112 | N/A | N/A | 449545 | 449564 | TCTCCATCTCAAAACATGCT | 108 | 2019 |
| 1042144 | N/A | N/A | 449841 | 449860 | CTACCTAGACAATGTACTTT | 86 | 2020 |
| 1042176 | N/A | N/A | 450127 | 450146 | CCCACCTGGCCTGTTAATGA | 86 | 2021 |
| 1042208 | N/A | N/A | 451135 | 451154 | CCAGCCTAAAAAATTGGAGA | 94 | 2022 |
| 1042240 | N/A | N/A | 451524 | 451543 | CACCGAGATAATATACACAA | 18 | 2023 |
| 1042272 | N/A | N/A | 451875 | 451894 | ACTGTGTTCTCATAGGTAAA | 32 | 2024 |
| 1042304 | N/A | N/A | 452173 | 452192 | AAGTCATAAAAATAAAACTC | 99 | 2025 |
| 1042336 | N/A | N/A | 452454 | 452473 | ACTCATACAATTCTAGTTAC | 44 | 2026 |
| 1042368 | N/A | N/A | 452952 | 452971 | AGCATGAACCCCTTCTCCTG | 78 | 2027 |
| 1042400 | N/A | N/A | 453743 | 453762 | AGCAAAAGATCCTTCCAGA | 90 | 2028 |
| 1042432 | N/A | N/A | 454556 | 454575 | ATAGAGACAAAAGATGGTC | 104 | 2029 |
| 1042464 | N/A | N/A | 455200 | 455219 | GCACTAGCAAAATATCAGAT | 28 | 2030 |
| 1042496 | N/A | N/A | 456172 | 456191 | TCTGGACAAAATGTTTAAAC | 35 | 2031 |
| 1042528 | N/A | N/A | 456881 | 456900 | AATATTCAAAATATTCCATC | 64 | 2032 |

TABLE 28

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040097 | 1933 | 1952 | 436652 | 436671 | CTCACCGTTCAGGACCTCCT | 73 | 2033 |
| 1040129 | 3048 | 3067 | 457301 | 457320 | TGGCCCTTTTTAACAGAGCC | 113 | 2034 |
| 1040161 | 3670 | 3689 | 457923 | 457942 | AGCCCCGTTCCTTTCTTCCC | 46 | 2035 |
| 1040193 | 4328 | 4347 | 458581 | 458600 | TTGCATCTACCTCTTGGGAG | 44 | 2036 |
| 1040225 | 4729 | 4748 | 458982 | 459001 | ACATTCATCCCTTTAAACCA | 33 | 2037 |
| 1040257 | 5032 | 5051 | 459285 | 459304 | GCTACATTTATTTATGCTCG | 14 | 2038 |
| 1040289 | 5417 | 5436 | 459670 | 459689 | GCACTTTAAAGATGCATTCA | 29 | 2039 |
| 1040321 | 5786 | 5805 | 460039 | 460058 | ACAGCACTAAATAAGCAGTA | 28 | 2040 |
| 1040353 | 6129 | 6148 | 460382 | 460401 | AACCAATTATTTTATAATTC | 112 | 2041 |
| 1040385 | 6942 | 6961 | 461195 | 461214 | GCTGTCGGTAAATATTGCAA | 36 | 2042 |
| 1040417 | 7406 | 7425 | 461659 | 461678 | ACCTAACAGAAAACATAGAG | 36 | 2043 |
| 1040449 | 7882 | 7901 | 462135 | 462154 | AGTGTCTTCAAAAGCATTGG | 22 | 2044 |
| 1040481 | 8231 | 8250 | 462484 | 462503 | TCTCTGTATATTTATTACTT | 10 | 2045 |
| 1040513 | 8598 | 8617 | 462851 | 462870 | AGCCATATCTTTCAAACACT | 8 | 2046 |
| 1040545 | 8973 | 8992 | 463226 | 463245 | TCTTTGGGTTTATAGGAACA | 14 | 2047 |
| 1040577 | 9297 | 9316 | 463550 | 463569 | TTCTGAATTTAAGAATTGTA | 83 | 2048 |

TABLE 28-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040609 | 9647 | 9666 | 463900 | 463919 | CACTTCCAACGAAGGCCTTC | 100 | 2049 |
| 1040641 | 10192 | 10211 | 464445 | 464464 | CCCTAGTTCTCCTCTGTACT | 79 | 2050 |
| 1040673 | 10414 | 10433 | 464667 | 464686 | GTATCCTACAAATAGACACA | 56 | 2051 |
| 1040705 | N/A | N/A | 9443 | 9462 | ACTCACTATTTTAAGAGCA | 49 | 2052 |
| 1040737 | N/A | N/A | 25793 | 25812 | CTGGGAATTTAAAAACAAA | 77 | 2053 |
| 1040769 | N/A | N/A | 40905 | 40924 | TCCATAAACATTTATACAGA | 5 | 2054 |
| 1040801 | N/A | N/A | 71139 | 71158 | GGTTCAAAACCTTAGTCAGA | 69 | 2055 |
| 1040833 | N/A | N/A | 85391 | 85410 | ATAGAATATTTTATCATTC | 91 | 2056 |
| 1040865 | N/A | N/A | 108193 | 108212 | GAATAAATTATTTACTGCGG | 8 | 2057 |
| 1040897 | N/A | N/A | 140551 | 140570 | GGTCAATTTCAAACTGTTCT | 5 | 2058 |
| 1040929 | N/A | N/A | 166245 | 166264 | GGCCTAAAACTATTCTTGAT | 118 | 2059 |
| 1040961 | N/A | N/A | 187483 | 187502 | ACACTTAAACCTGTTAATAT | 78 | 2060 |
| 1040993 | N/A | N/A | 208043 | 208062 | GCTCATAAAATACCTCTCTA | 16 | 2061 |
| 1041025 | N/A | N/A | 227432 | 227451 | CCAGGAAAGATTTATTTAGC | 51 | 2062 |
| 1041057 | N/A | N/A | 250936 | 250955 | AGCACATTTCAAAAGTTCAG | 53 | 2063 |
| 1041089 | N/A | N/A | 270476 | 270495 | ATTCATTTTCCTTATGTTAC | 58 | 2064 |
| 1041121 | N/A | N/A | 286774 | 286793 | TCACCCAAACCCATTGCCTA | 77 | 2065 |
| 1041153 | N/A | N/A | 317256 | 317275 | TTCTGTAAAATATATCCTGT | 19 | 2066 |
| 1041185 | N/A | N/A | 335931 | 335950 | ATCTGTAAAATATGGTTGCA | 7 | 2067 |
| 1041217 | N/A | N/A | 362937 | 362956 | AACTTATTTTAAAGTGTCCA | 2 | 2068 |
| 1041249 | N/A | N/A | 385646 | 385665 | ACATTATACCCTTAATATCC | 39 | 2069 |
| 1041281 | N/A | N/A | 410116 | 410135 | GCTGTAAAAATACACATCCT | 18 | 2070 |
| 1041313 | N/A | N/A | 437751 | 437770 | GCTTATTTTTTCTAGAGAAC | 54 | 2071 |
| 1041345 | N/A | N/A | 438169 | 438188 | AGTGATAGTCACAGGTTCAG | 12 | 2072 |
| 1041377 | N/A | N/A | 438486 | 438505 | TTATCCACTCTAACCAATCC | 101 | 2073 |
| 1041409 | N/A | N/A | 439093 | 439112 | CCACGCTTTTATTTTCTGAT | 1 | 2074 |
| 1041441 | N/A | N/A | 439441 | 439460 | CAGCTATTTCATGACTATTT | 7 | 2075 |
| 1041473 | N/A | N/A | 440091 | 440110 | GAGCTGTATTATTATGCCAT | 107 | 2076 |
| 1041505 | N/A | N/A | 440318 | 440337 | CAGTCGCATTTCTAAACAAA | 76 | 2077 |
| 1041537 | N/A | N/A | 441122 | 441141 | CGGTAAAGTGACAAATCATT | 12 | 2078 |
| 1041569 | N/A | N/A | 441521 | 441540 | CTGCCTAGAGTCACAATGCC | 31 | 2079 |
| 1041601 | N/A | N/A | 442149 | 442168 | ACGCTAATAAATTTTTACAA | 109 | 2080 |
| 1041633 | N/A | N/A | 442624 | 442643 | ACTCTCAACCAGAATCAAGG | 86 | 2081 |
| 1041665 | N/A | N/A | 443023 | 443042 | CCTCTCCTTCCATAAACTCT | 85 | 2082 |
| 1041697 | N/A | N/A | 443457 | 443476 | CTGTGTACTCTTCAGAGAAG | 27 | 2083 |
| 1041729 | N/A | N/A | 443817 | 443836 | ACCAGCTAATCCATTCAATG | 17 | 2084 |

TABLE 28-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041761 | N/A | N/A | 444251 | 444270 | AACAATAGTCTTTAATTTTT | 109 | 2085 |
| 1041793 | N/A | N/A | 445143 | 445162 | GTGAGTGACCACAGCAGCTG | 110 | 2086 |
| 1041825 | N/A | N/A | 445458 | 445477 | AGCGAGAGACCCATTTACTG | 23 | 2087 |
| 1041857 | N/A | N/A | 445767 | 445786 | CTGTTTTCACAAATTGCGAA | 44 | 2088 |
| 1041889 | N/A | N/A | 445978 | 445997 | CAATAAAATTCCTTTCACCA | 37 | 2089 |
| 1041921 | N/A | N/A | 446354 | 446373 | GCCTTTATACTTTTGTAAGC | 73 | 2090 |
| 1041953 | N/A | N/A | 446832 | 446851 | GTTTCTGATTAAATCCCAAT | 18 | 2091 |
| 1041985 | N/A | N/A | 447607 | 447626 | TGCCTCTTTCCCCAAACTCA | 47 | 2092 |
| 1042017 | N/A | N/A | 448370 | 448389 | GAGAACTCCCCTGACAGTTC | 90 | 2093 |
| 1042049 | N/A | N/A | 448679 | 448698 | ACATCACAAACATCCCAATT | 71 | 2094 |
| 1042081 | N/A | N/A | 449045 | 449064 | GATACATTTCAGGCTTTCCA | 13 | 2095 |
| 1042113 | N/A | N/A | 449571 | 449590 | CTTGAAATTCCCTTGGAGAG | 42 | 2096 |
| 1042145 | N/A | N/A | 449843 | 449862 | AACTACCTAGACAATGTACT | 65 | 2097 |
| 1042177 | N/A | N/A | 450452 | 450471 | CGTACTAAAACAAGATGACG | 51 | 2098 |
| 1042209 | N/A | N/A | 451136 | 451155 | ACCAGCCTAAAAAATTGGAG | 72 | 2099 |
| 1042241 | N/A | N/A | 451525 | 451544 | GCACCGAGATAATATACACA | 13 | 2100 |
| 1042273 | N/A | N/A | 451891 | 451910 | TCTGAAAATAACATCTACTG | 43 | 2101 |
| 1042305 | N/A | N/A | 452175 | 452194 | CCAAGTCATAAAAATAAAAC | 104 | 2102 |
| 1042337 | N/A | N/A | 452460 | 452479 | ATAGCCACTCATACAATTCT | 34 | 2103 |
| 1042369 | N/A | N/A | 452953 | 452972 | AAGCATGAACCCCTTCTCCT | 66 | 2104 |
| 1042401 | N/A | N/A | 453745 | 453764 | GGAGCAAAAGATCCTTCCA | 91 | 2105 |
| 1042433 | N/A | N/A | 454600 | 454619 | GGATTCTCTAATTAGAGCTT | 41 | 2106 |
| 1042465 | N/A | N/A | 455224 | 455243 | GAGGAGACCAGATAGCTTGT | 79 | 2107 |
| 1042497 | N/A | N/A | 456173 | 456192 | CTCTGGACAAAATGTTTAAA | 82 | 2108 |
| 1042529 | N/A | N/A | 456883 | 456902 | TCAATATTCAAAATATTCCA | 98 | 2109 |

TABLE 29

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040098 | 2110 | 2129 | 436829 | 436848 | GGGCAGGACCATCACAGAGG | 60 | 2110 |
| 1040130 | 3049 | 3068 | 457302 | 457321 | CTGGCCCTTTTTAACAGAGC | 107 | 2111 |
| 1040162 | 3765 | 3784 | 458018 | 458037 | CTGCAGGACCCTTCCACGG | 118 | 2112 |
| 1040194 | 4393 | 4412 | 458646 | 458665 | TCAAAGACAAAAAGATTTCG | 75 | 2113 |

TABLE 29-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040226 | 4733 | 4752 | 458986 | 459005 | ATTCACATTCATCCCTTTAA | 35 | 2114 |
| 1040258 | 5048 | 5067 | 459301 | 459320 | GTTAGAAAGAAATTTTGCTA | 58 | 2115 |
| 1040290 | 5442 | 5461 | 459695 | 459714 | CCTACTTATAAAACTTTTTT | 114 | 2116 |
| 1040322 | 5787 | 5806 | 460040 | 460059 | TACAGCACTAAATAAGCAGT | 68 | 2117 |
| 1040354 | 6177 | 6196 | 460430 | 460449 | CACATGCTAAAAAGCAAGA | 86 | 2118 |
| 1040386 | 6960 | 6979 | 461213 | 461232 | AAGAAAGAACAAAAGACGGC | 66 | 2119 |
| 1040418 | 7407 | 7426 | 461660 | 461679 | CACCTAACAGAAAACATAGA | 118 | 2120 |
| 1040450 | 7883 | 7902 | 462136 | 462155 | TAGTGTCTTCAAAAGCATTG | 39 | 2121 |
| 1040482 | 8238 | 8257 | 462491 | 462510 | AGTATATTCTCTGTATATTT | 29 | 2122 |
| 1040514 | 8599 | 8618 | 462852 | 462871 | GAGCCATATCTTTCAAACAC | 25 | 2123 |
| 1040546 | 8986 | 9005 | 463239 | 463258 | TTCAAGATTATATTCTTTGG | 52 | 2124 |
| 1040578 | 9328 | 9347 | 463581 | 463600 | GTTGCCTTCAACGAGAAGGG | 62 | 2125 |
| 1040610 | 9658 | 9677 | 463911 | 463930 | ACTGTAAACAACACTTCCAA | 22 | 2126 |
| 1040642 | 10204 | 10223 | 464457 | 464476 | ACATCATTCCTTCCCTAGTT | 29 | 2127 |
| 1040674 | 10415 | 10434 | 464668 | 464687 | TGTATCCTACAAATAGACAC | 78 | 2128 |
| 1040706 | N/A | N/A | 9658 | 9677 | GGCTGATTTTAAACTTAGTT | 31 | 2129 |
| 1040738 | N/A | N/A | 26160 | 26179 | GTTTTATATTTTAAGTGCT | 7 | 2130 |
| 1040770 | N/A | N/A | 40931 | 40950 | ACATTTAAAATATTTCAGAC | 108 | 2131 |
| 1040802 | N/A | N/A | 71486 | 71505 | TGTCTATTTTAAAGACTCAA | 112 | 2132 |
| 1040834 | N/A | N/A | 85731 | 85750 | GGATATCTATTTTAATTCTT | 62 | 2133 |
| 1040866 | N/A | N/A | 108791 | 108810 | ACAGTATTTCAAAAGAAGCC | 73 | 2134 |
| 1040898 | N/A | N/A | 140712 | 140731 | CTGGATAATACCTAACTGTC | 58 | 2135 |
| 1040930 | N/A | N/A | 167395 | 167414 | AGTGACTTAGATTATCCTTT | 17 | 2136 |
| 1040962 | N/A | N/A | 187991 | 188010 | CACATCAAACCTCAAGGGCA | 64 | 2137 |
| 1040994 | N/A | N/A | 208238 | 208257 | GTTTCCCTAATTTATGGAGT | 52 | 2138 |
| 1041026 | N/A | N/A | 227529 | 227548 | ATTCTTACAATTTACTTGTA | 96 | 2139 |
| 1041058 | N/A | N/A | 251431 | 251450 | ATTCTCTTTTAAAGATAAAG | 119 | 2140 |
| 1041090 | N/A | N/A | 270489 | 270508 | CTATGGTTTTAAAATTCATT | 82 | 2141 |
| 1041122 | N/A | N/A | 287171 | 287190 | ACTACCAGCCCTTATTTCAG | 20 | 2142 |
| 1041154 | N/A | N/A | 318500 | 318519 | CTCTGCTTTCAAATGTGTTT | 6 | 2143 |
| 1041186 | N/A | N/A | 338862 | 338881 | TCTTTCATATTTTAAAGTGC | 3 | 2144 |
| 1041218 | N/A | N/A | 365191 | 365210 | TCCAGTAAAAACACAACACT | 44 | 2145 |
| 1041250 | N/A | N/A | 385654 | 385673 | TATAATATACATTATACCCT | 78 | 2146 |
| 1041282 | N/A | N/A | 410286 | 410305 | CCACAATTACAAACACACTT | 41 | 2147 |
| 1041314 | N/A | N/A | 437752 | 437771 | GGCTTATTTTTTCTAGAGAA | 18 | 2148 |
| 1041346 | N/A | N/A | 438171 | 438190 | GCAGTGATAGTCACAGGTTC | 19 | 2149 |

TABLE 29-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041378 | N/A | N/A | 438490 | 438509 | GGAATTATCCACTCTAACCA | 56 | 2150 |
| 1041410 | N/A | N/A | 439101 | 439120 | TGTATTAACCACGCTTTTAT | 31 | 2151 |
| 1041442 | N/A | N/A | 439443 | 439462 | AGCAGCTATTTCATGACTAT | 19 | 2152 |
| 1041474 | N/A | N/A | 440093 | 440112 | GTGAGCTGTATTATTATGCC | 62 | 2153 |
| 1041506 | N/A | N/A | 440327 | 440346 | GCAAGGAACCAGTCGCATTT | 56 | 2154 |
| 1041538 | N/A | N/A | 441144 | 441163 | AGCCGATTTCTGATAGGCTC | 78 | 2155 |
| 1041570 | N/A | N/A | 441530 | 441549 | GCAGGATTTCTGCCTAGAGT | 39 | 2156 |
| 1041602 | N/A | N/A | 442188 | 442207 | ATGTTCATCTTAATGCTCTT | 21 | 2157 |
| 1041634 | N/A | N/A | 442625 | 442644 | GACTCTCAACCAGAATCAAG | 111 | 2158 |
| 1041666 | N/A | N/A | 443025 | 443044 | TGCCTCTCCTTCCATAAACT | 89 | 2159 |
| 1041698 | N/A | N/A | 443481 | 443500 | TTTTACAACTCCACTGAGCA | 53 | 2160 |
| 1041730 | N/A | N/A | 443834 | 443853 | CTCGGCTATTTTTAGGTACC | 51 | 2161 |
| 1041762 | N/A | N/A | 444258 | 444277 | TGCTTTAAACAATAGTCTTT | 81 | 2162 |
| 1041794 | N/A | N/A | 445146 | 445165 | CCAGTGAGTGACCACAGCAG | 99 | 2163 |
| 1041826 | N/A | N/A | 445484 | 445503 | ACCCCGTCTCAAAGATGAAG | 102 | 2164 |
| 1041858 | N/A | N/A | 445769 | 445788 | CCCTGTTTTCACAAATTGCG | 62 | 2165 |
| 1041890 | N/A | N/A | 445979 | 445998 | TCAATAAAATTCCTTTCACC | 60 | 2166 |
| 1041922 | N/A | N/A | 446355 | 446374 | GGCCTTTATACTTTTGTAAG | 103 | 2167 |
| 1041954 | N/A | N/A | 446834 | 446853 | TGGTTTCTGATTAAATCCCA | 49 | 2168 |
| 1041986 | N/A | N/A | 447630 | 447649 | TTTACTTGTATATTTGTCTG | 15 | 2169 |
| 1042018 | N/A | N/A | 448384 | 448403 | CTGTCCTTTTCAGAGAGAAC | 88 | 2170 |
| 1042050 | N/A | N/A | 448680 | 448699 | TACATCACAAACATCCCAAT | 97 | 2171 |
| 1042082 | N/A | N/A | 449048 | 449067 | AATGATACATTTCAGGCTTT | 47 | 2172 |
| 1042114 | N/A | N/A | 449591 | 449610 | ATATATCATCAAATCTGTTG | 44 | 2173 |
| 1042146 | N/A | N/A | 449851 | 449870 | TTAGTGTGAACTACCTAGAC | 85 | 2174 |
| 1042178 | N/A | N/A | 450505 | 450524 | CTGCCGAAAAATTCACGAGA | 95 | 2175 |
| 1042210 | N/A | N/A | 451137 | 451156 | AACCAGCCTAAAAAATTGGA | 88 | 2176 |
| 1042242 | N/A | N/A | 451539 | 451558 | AGGATAATTTTATGGCACCG | 14 | 2177 |
| 1042274 | N/A | N/A | 451905 | 451924 | GCAATATTTAATTTTCTGAA | 36 | 2178 |
| 1042306 | N/A | N/A | 452185 | 452204 | TGCTGCAAATCCAAGTCATA | 51 | 2179 |
| 1042338 | N/A | N/A | 452464 | 452483 | CCTTATAGCCACTCTATACAA | 42 | 2180 |
| 1042370 | N/A | N/A | 452976 | 452995 | AGTACATTCATATGGCAGCT | 27 | 2181 |
| 1042402 | N/A | N/A | 453759 | 453778 | GGCGAATTCTATATGGACA | 98 | 2182 |
| 1042434 | N/A | N/A | 454604 | 454623 | AACTGGATTCTCTAATTAGA | 59 | 2183 |

TABLE 29-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042466 | N/A | N/A | 455257 | 455276 | GCATTCAATTTAAAAAGGG | 66 | 2184 |
| 1042498 | N/A | N/A | 456187 | 456206 | AATAAATTTAAAAACTCTGG | 108 | 2185 |
| 1042530 | N/A | N/A | 456884 | 456903 | ATCAATATTCAAAATATTCC | 89 | 2186 |

TABLE 30

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040099 | 2149 | 2168 | 436868 | 436887 | CTGTTGCACCTCCAGGTCAG | 77 | 2187 |
| 1040131 | 3050 | 3069 | 457303 | 457322 | GCTGGCCCTTTTTAACAGAG | 110 | 2188 |
| 1040163 | 3800 | 3819 | 458053 | 458072 | CCTGTGCACCCCCACATGCG | 107 | 2189 |
| 1040195 | 4416 | 4435 | 458669 | 458688 | TGAACTATAAACAGTACTAG | 69 | 2190 |
| 1040227 | 4734 | 4753 | 458987 | 459006 | AATTCACATTCATCCCTTTA | 34 | 2191 |
| 1040259 | 5079 | 5098 | 459332 | 459351 | AACCTTATAAAATGGCCTAG | 70 | 2192 |
| 1040291 | 5446 | 5465 | 459699 | 459718 | TCTCCCTACTTATAAAACTT | 31 | 2193 |
| 1040323 | 5788 | 5807 | 460041 | 460060 | ATACAGCACTAAATAAGCAG | 77 | 2194 |
| 1040355 | 6207 | 6226 | 460460 | 460479 | GGTCAGACTCTATTGGCACA | 10 | 2195 |
| 1040387 | 6987 | 7006 | 461240 | 461259 | TTACTAGTTTAAAAATGGAA | 100 | 2196 |
| 1040419 | 7414 | 7433 | 461667 | 461686 | ACACACTCACCTAACAGAAA | 68 | 2197 |
| 1040451 | 7915 | 7934 | 462168 | 462187 | CTTCCTCACCCATATCTGAA | 45 | 2198 |
| 1040483 | 8250 | 8269 | 462503 | 462522 | GCTTTATAAAAAAGTATATT | 139 | 2199 |
| 1040515 | 8600 | 8619 | 462853 | 462872 | AGAGCCATATCTTTCAAACA | 31 | 2200 |
| 1040547 | 8988 | 9007 | 463241 | 463260 | TGTTCAAGATTATATTCTTT | 73 | 2201 |
| 1040579 | 9332 | 9351 | 463585 | 463604 | AACAGTTGCCTTCAACGAGA | 29 | 2202 |
| 1040611 | 9661 | 9680 | 463914 | 463933 | ATTACTGTAAACAACACTTC | 52 | 2203 |
| 1040643 | 10205 | 10224 | 464458 | 464477 | AACATCATTCCTTCCCTAGT | 33 | 2204 |
| 1040675 | 10418 | 10437 | 464671 | 464690 | GAGTGTATCCTACAAATAGA | 53 | 2205 |
| 1040707 | N/A | N/A | 11372 | 11391 | TCTAGCAAACCTCTTTTTCC | 57 | 2206 |
| 1040739 | N/A | N/A | 27282 | 27301 | AGGTATAAATCCCCTTTCCA | 31 | 2207 |
| 1040771 | N/A | N/A | 41291 | 41310 | GATAGTAATCAAACCTGAGT | 43 | 2208 |
| 1040803 | N/A | N/A | 71489 | 71508 | ATTTGTCTATTTAAAGACT | 117 | 2209 |
| 1040835 | N/A | N/A | 87443 | 87462 | ATGAGTAAAATATGGTCCTT | 43 | 2210 |
| 1040867 | N/A | N/A | 109082 | 109101 | CACTTCATAATTTAATATTT | 92 | 2211 |
| 1040899 | N/A | N/A | 141267 | 141286 | GTGATATTTTAAAGACTTAC | 6 | 2212 |

TABLE 30-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040931 | N/A | N/A | 168114 | 168133 | AGGGCCTTATTTTAATCACA | 106 | 2213 |
| 1040963 | N/A | N/A | 188513 | 188532 | CATTTATTTCCTTACCCAGT | 6 | 2214 |
| 1040995 | N/A | N/A | 208356 | 208375 | GTGTCTAAAACCAACTGGGT | 28 | 2215 |
| 1041027 | N/A | N/A | 227703 | 227722 | AAGCCAATATTTTATTTTGA | 96 | 2216 |
| 1041059 | N/A | N/A | 251853 | 251872 | GGTGATAAAGATATCATTAC | 67 | 2217 |
| 1041091 | N/A | N/A | 270781 | 270800 | TTCGAAATTCTTTATTTGAT | 136 | 2218 |
| 1041123 | N/A | N/A | 287520 | 287539 | CACTATAAAGAATGATGAGT | 5 | 2219 |
| 1041155 | N/A | N/A | 318566 | 318585 | TAGAGAAAACGATGTTGGCT | 3 | 2220 |
| 1041187 | N/A | N/A | 339528 | 339547 | CCTTCGGCTATTTAATAATA | 75 | 2221 |
| 1041219 | N/A | N/A | 365605 | 365624 | AGGCATCTAATTTAAATTCA | 20 | 2222 |
| 1041251 | N/A | N/A | 386171 | 386190 | GCTTGTAAAACTATGGCGGC | 87 | 2223 |
| 1041283 | N/A | N/A | 413867 | 413886 | GGCAATAAAATATTTAATGG | 71 | 2224 |
| 1041315 | N/A | N/A | 437753 | 437772 | GGGCTTATTTTTCTAGAGA | 33 | 2225 |
| 1041347 | N/A | N/A | 438223 | 438242 | ACATTATATATATGTTGGAG | 16 | 2226 |
| 1041379 | N/A | N/A | 438493 | 438512 | ACTGGAATTATCCACTCTAA | 40 | 2227 |
| 1041411 | N/A | N/A | 439103 | 439122 | ATTGTATTAACCACGCTTTT | 29 | 2228 |
| 1041443 | N/A | N/A | 439444 | 439463 | TAGCAGCTATTTCATGACTA | 15 | 2229 |
| 1041475 | N/A | N/A | 440117 | 440136 | GTGAACAGCCACTACAGAGG | 76 | 2230 |
| 1041507 | N/A | N/A | 440360 | 440379 | CCTTCATTCTCAAGCTGAAG | 88 | 2231 |
| 1041539 | N/A | N/A | 441150 | 441169 | GATGTCAGCCGATTTCTGAT | 30 | 2232 |
| 1041571 | N/A | N/A | 441554 | 441573 | AGGCATCCTCAAGAGTCTGT | 32 | 2233 |
| 1041603 | N/A | N/A | 442192 | 442211 | GTACATGTTCATCTTAATGC | 12 | 2234 |
| 1041635 | N/A | N/A | 442626 | 442645 | GGACTCTCAACCAGAATCAA | 118 | 2235 |
| 1041667 | N/A | N/A | 443027 | 443046 | GCTGCCTCTCCTTCCATAAA | 64 | 2236 |
| 1041699 | N/A | N/A | 443488 | 443507 | CAATACATTTTACAACTCCA | 27 | 2237 |
| 1041731 | N/A | N/A | 443871 | 443890 | CTGACTCTACAGGCTCATGT | 51 | 2238 |
| 1041763 | N/A | N/A | 444259 | 444278 | CTGCTTTAAACAATAGTCTT | 70 | 2239 |
| 1041795 | N/A | N/A | 445170 | 445189 | AGGGATGGCCAGGAAGGACA | 96 | 2240 |
| 1041827 | N/A | N/A | 445492 | 445511 | ATCAGAAAACCCCGTCTCAA | 104 | 2241 |
| 1041859 | N/A | N/A | 445770 | 445789 | TCCCTGTTTTCACAAATTGC | 68 | 2242 |
| 1041891 | N/A | N/A | 445980 | 445999 | TTCAATAAAATTCCTTTCAC | 93 | 2243 |
| 1041923 | N/A | N/A | 446357 | 446376 | ATGGCCTTTATACTTTTGTA | 116 | 2244 |
| 1041955 | N/A | N/A | 446849 | 446868 | ACACATTTTCCAGAATGGTT | 16 | 2245 |
| 1041987 | N/A | N/A | 447638 | 447657 | CTTTTTTATTTACTTGTATA | 80 | 2246 |
| 1042019 | N/A | N/A | 448386 | 448405 | CACTGTCCTTTTCAGAGAGA | 68 | 2247 |
| 1042051 | N/A | N/A | 448682 | 448701 | CTTACATCACAAACATCCCA | 95 | 2248 |

TABLE 30-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
| --- | --- | --- | --- | --- | --- | --- | --- |
| 1042083 | N/A | N/A | 449050 | 449069 | CTAATGATACATTTCAGGCT | 46 | 2249 |
| 1042115 | N/A | N/A | 449593 | 449612 | ATATATATCATCAAATCTGT | 23 | 2250 |
| 1042147 | N/A | N/A | 449862 | 449881 | CTCCTCACTAATTAGTGTGA | 110 | 2251 |
| 1042179 | N/A | N/A | 450507 | 450526 | GCCTGCCGAAAAATTCACGA | 144 | 2252 |
| 1042211 | N/A | N/A | 451139 | 451158 | CCAACCAGCCTAAAAAATTG | 122 | 2253 |
| 1042243 | N/A | N/A | 451540 | 451559 | TAGGATAATTTTATGGCACC | 8 | 2254 |
| 1042275 | N/A | N/A | 451908 | 451927 | CAGGCAATATTTAATTTTCT | 11 | 2255 |
| 1042307 | N/A | N/A | 452186 | 452205 | TTGCTGCAAATCCAAGTCAT | 34 | 2256 |
| 1042339 | N/A | N/A | 452466 | 452485 | TGCCTTATAGCCACTCATAC | 33 | 2257 |
| 1042371 | N/A | N/A | 452978 | 452997 | TGAGTACATTCATATGGCAG | 13 | 2258 |
| 1042403 | N/A | N/A | 453760 | 453779 | TGGCGAATTCTATATGGAGC | 63 | 2259 |
| 1042435 | N/A | N/A | 454638 | 454657 | AGTTGAATAGACATGGATTA | 73 | 2260 |
| 1042467 | N/A | N/A | 455281 | 455300 | ACTTTCACAATTTTGCAAAT | 45 | 2261 |
| 1042499 | N/A | N/A | 456211 | 456230 | TCTGAACAAAAATATAAGCA | 106 | 2262 |
| 1042531 | N/A | N/A | 456890 | 456909 | AAGGTCATCAATATTCAAAA | 19 | 2263 |

TABLE 31

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
| --- | --- | --- | --- | --- | --- | --- | --- |
| 994605 | N/A | N/A | 17726 | 17745 | GTCACCTTTTCTATTTGCAC | 3 | 138 |
| 1040100 | 2215 | 2234 | 436934 | 436953 | AGGCTTCCCTAAATGCAGGC | 69 | 2264 |
| 1040132 | 3098 | 3117 | 457351 | 457370 | GGCCGTCGGCCTTTGAGTGC | 106 | 2265 |
| 1040164 | 3838 | 3857 | 458091 | 458110 | AGGCAGAGAAAAAGAGACCC | 72 | 2266 |
| 1040196 | 4421 | 4440 | 458674 | 458693 | AGTCATGAACTATAAACAGT | 34 | 2267 |
| 1040228 | 4736 | 4755 | 458989 | 459008 | ATAATTCACATTCATCCCTT | 28 | 2268 |
| 1040260 | 5084 | 5103 | 459337 | 459356 | AACATAACCTTATAAAATGG | 82 | 2269 |
| 1040292 | 5447 | 5466 | 459700 | 459719 | TTCTCCCTACTTATAAAACT | 48 | 2270 |
| 1040324 | 5798 | 5817 | 460051 | 460070 | CGTTTAAAAAATACAGCACT | 49 | 2271 |
| 1040356 | 6228 | 6247 | 460481 | 460500 | GCTTTAACTATATAGCACAC | 78 | 2272 |
| 1040388 | 6995 | 7014 | 461248 | 461267 | GCCTGCTGTTACTAGTTTAA | 31 | 2273 |
| 1040420 | 7415 | 7434 | 461668 | 461687 | AACACACTCACCTAACAGAA | 47 | 2274 |
| 1040452 | 7920 | 7939 | 462173 | 462192 | CTCTGCTTCCTCACCCATAT | 36 | 2275 |
| 1040484 | 8251 | 8270 | 462504 | 462523 | TGCTTTATAAAAAGTATAT | 128 | 2276 |

TABLE 31-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040516 | 8606 | 8625 | 462859 | 462878 | TTCAACAGAGCCATATCTTT | 65 | 2277 |
| 1040548 | 8989 | 9008 | 463242 | 463261 | GTGTTCAAGATTATATTCTT | 40 | 2278 |
| 1040580 | 9344 | 9363 | 463597 | 463616 | GTTAGCTACCAGAACAGTTG | 40 | 2279 |
| 1040612 | 9667 | 9686 | 463920 | 463939 | GTAAGGATTACTGTAAACAA | 12 | 2280 |
| 1040644 | 10208 | 10227 | 464461 | 464480 | CAAAACATCATTCCTTCCCT | 84 | 2281 |
| 1040676 | 10419 | 10438 | 464672 | 464691 | CGAGTGTATCCTACAAATAG | 56 | 2282 |
| 1040708 | N/A | N/A | 11914 | 11933 | TGCCAGAGAATTTATATGTA | 10 | 2283 |
| 1040740 | N/A | N/A | 27352 | 27371 | CCTGTCAAAACCAGTCACTC | 60 | 2284 |
| 1040772 | N/A | N/A | 41515 | 41534 | CTAATAATAGTCTAATTACA | 134 | 2285 |
| 1040804 | N/A | N/A | 71673 | 71692 | TTGTGCTTTTAAATTCAAAC | 10 | 2286 |
| 1040836 | N/A | N/A | 87528 | 87547 | ACATCCTTTTAAATGTTAGG | 31 | 2287 |
| 1040868 | N/A | N/A | 109301 | 109320 | TGTCTTAATCAAACCTCCCG | 50 | 2288 |
| 1040900 | N/A | N/A | 141437 | 141456 | CAGTTCTATTTTTAGTTATA | 10 | 2289 |
| 1040932 | N/A | N/A | 168436 | 168455 | ATTTACCTTCTTTAACACAA | 66 | 2290 |
| 1040964 | N/A | N/A | 188787 | 188806 | GGGATATTTTAAAATTCTAC | 54 | 2291 |
| 1040996 | N/A | N/A | 208934 | 208953 | CCTGGGTTTCAAAGATTCCT | 100 | 2292 |
| 1041028 | N/A | N/A | 229640 | 229659 | TAGAGAATTCAAAGCACCAA | 46 | 2293 |
| 1041060 | N/A | N/A | 253001 | 253020 | TCAAAGTTTTAAAGAGTTTT | 88 | 2294 |
| 1041092 | N/A | N/A | 271090 | 271109 | TGCTCCAAACCCAGCTCCTC | 132 | 2295 |
| 1041124 | N/A | N/A | 288911 | 288930 | CCCTACTCCTTTTATAGATG | 32 | 2296 |
| 1041156 | N/A | N/A | 319014 | 319033 | TCATCCAAACCCAGACGGGT | 120 | 2297 |
| 1041188 | N/A | N/A | 339984 | 340003 | ATAAAGTCCTTTTAACCCCT | 4 | 2298 |
| 1041220 | N/A | N/A | 367208 | 367227 | GTGCCCTTTTAAAATCTTTT | 6 | 2299 |
| 1041252 | N/A | N/A | 386698 | 386717 | AGCCAAAAATACATCCACCT | 24 | 2300 |
| 1041284 | N/A | N/A | 413882 | 413901 | ACTGTAATCTAAACAGGCAA | 87 | 2301 |
| 1041316 | N/A | N/A | 437786 | 437805 | TTCATTACACACAGCAGAGA | 26 | 2302 |
| 1041348 | N/A | N/A | 438225 | 438244 | AGACATTATATATATGTTGG | 27 | 2303 |
| 1041380 | N/A | N/A | 438512 | 438531 | CCCCTACACCCCAGAGCACA | 109 | 2304 |
| 1041412 | N/A | N/A | 439104 | 439123 | GATTGTATTAACCACGCTTT | 18 | 2305 |
| 1041444 | N/A | N/A | 439457 | 439476 | TGAATGTCCCAAATAGCAGC | 34 | 2306 |
| 1041476 | N/A | N/A | 440138 | 440157 | CACCCCTAATTCATGCAGGA | 72 | 2307 |
| 1041508 | N/A | N/A | 440361 | 440380 | GCCTTCATTCTCAAGCTGAA | 43 | 2308 |
| 1041540 | N/A | N/A | 441162 | 441181 | TTTAGCTGTGATGATGTCAG | 51 | 2309 |
| 1041572 | N/A | N/A | 441556 | 441575 | TCAGGCATCCTCAAGAGTCT | 68 | 2310 |
| 1041604 | N/A | N/A | 442235 | 442254 | CTTTAGTTCCCATGAGGTCT | 41 | 2311 |
| 1041636 | N/A | N/A | 442680 | 442699 | AAGTGGATTATATTTGGCAG | 7 | 2312 |

TABLE 31-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041668 | N/A | N/A | 443031 | 443050 | ATCAGCTGCCTCTCCTTCCA | 47 | 2313 |
| 1041700 | N/A | N/A | 443489 | 443508 | CCAATACATTTTACAACTCC | 57 | 2314 |
| 1041732 | N/A | N/A | 443874 | 443893 | GGACTGACTCTACAGGCTCA | 41 | 2315 |
| 1041764 | N/A | N/A | 444260 | 444279 | ACTGCTTTAAACAATAGTCT | 65 | 2316 |
| 1041796 | N/A | N/A | 445235 | 445254 | TTTTTCTTACACATGGTAGC | 28 | 2317 |
| 1041828 | N/A | N/A | 445506 | 445525 | TCAGCATGAAAAAAATCAGA | 76 | 2318 |
| 1041860 | N/A | N/A | 445772 | 445791 | AGTCCCTGTTTTCACAAATT | 45 | 2319 |
| 1041892 | N/A | N/A | 446016 | 446035 | GCTTTTAAGAAAAATTTTAG | 123 | 2320 |
| 1041924 | N/A | N/A | 446359 | 446378 | GGATGGCCTTTATACTTTTG | 52 | 2321 |
| 1041956 | N/A | N/A | 446875 | 446894 | TCATTTTATGATCTTGCTGG | 25 | 2322 |
| 1041988 | N/A | N/A | 447659 | 447678 | CTGGTTATCTTCTTATGCAT | 89 | 2323 |
| 1042020 | N/A | N/A | 448422 | 448441 | TTTGGAATCTTTTTTGCCTC | 44 | 2324 |
| 1042052 | N/A | N/A | 448684 | 448703 | CTCTTACATCACAAACATCC | 102 | 2325 |
| 1042084 | N/A | N/A | 449054 | 449073 | GTTCCTAATGATACATTTCA | 52 | 2326 |
| 1042116 | N/A | N/A | 449594 | 449613 | AATATATATCATCAAATCTG | 46 | 2327 |
| 1042148 | N/A | N/A | 449866 | 449885 | TTTTCTCCTCACTAATTAGT | 112 | 2328 |
| 1042180 | N/A | N/A | 450508 | 450527 | AGCCTGCCGAAAAATTCACG | 116 | 2329 |
| 1042212 | N/A | N/A | 451152 | 451171 | CCATAAAAACCCTCCAACCA | 112 | 2330 |
| 1042244 | N/A | N/A | 451541 | 451560 | CTAGGATAATTTTATGGCAC | 9 | 2331 |
| 1042276 | N/A | N/A | 451909 | 451928 | GCAGGCAATATTTAATTTTC | 37 | 2332 |
| 1042308 | N/A | N/A | 452218 | 452237 | GGAAACCAATCCCACATCAA | 78 | 2333 |
| 1042340 | N/A | N/A | 452472 | 452491 | AGTGTTTGCCTTATAGCCAC | 20 | 2334 |
| 1042372 | N/A | N/A | 452979 | 452998 | TTGAGTACATTCATATGGCA | 30 | 2335 |
| 1042404 | N/A | N/A | 453783 | 453802 | TGCTAAAGAAAAAGAATTGT | 111 | 2336 |
| 1042436 | N/A | N/A | 454643 | 454662 | TTTCCAGTTGAATAGACATG | 62 | 2337 |
| 1042468 | N/A | N/A | 455285 | 455304 | AATTACTTTCACAATTTTGC | 27 | 2338 |
| 1042500 | N/A | N/A | 456212 | 456231 | CTCTGAACAAAAATATAAGC | 87 | 2339 |
| 1042532 | N/A | N/A | 456957 | 456976 | ACACACTATAAATGAGGCTC | 46 | 2340 |

TABLE 32

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040101 | 2216 | 2235 | 436935 | 436954 | CAGGCTTCCCTAAATGCAGG | 70 | 2341 |

TABLE 32-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040133 | 3109 | 3128 | 457362 | 457381 | GCTGCCCGCCAGGCCGTCGG | 111 | 2342 |
| 1040165 | 3880 | 3899 | 458133 | 458152 | CCCCCCCGGCCCATGCCGAT | 108 | 2343 |
| 1040197 | 4422 | 4441 | 458675 | 458694 | TAGTCATGAACTATAAACAG | 46 | 2344 |
| 1040229 | 4738 | 4757 | 458991 | 459010 | TCATAATTCACATTCATCCC | 16 | 2345 |
| 1040261 | 5106 | 5125 | 459359 | 459378 | GACCAAAATGAATTTTCAAA | 26 | 2346 |
| 1040293 | 5458 | 5477 | 459711 | 459730 | TATTTAAAAATTTCTCCCTA | 95 | 2347 |
| 1040325 | 5902 | 5921 | 460155 | 460174 | TCTTACCATCAAAGGCTAAA | 60 | 2348 |
| 1040357 | 6229 | 6248 | 460482 | 460501 | AGCTTTAACTATATAGCACA | 107 | 2349 |
| 1040389 | 7040 | 7059 | 461293 | 461312 | CCTGACTAATTTCTTGGTGA | 46 | 2350 |
| 1040421 | 7422 | 7441 | 461675 | 461694 | AAAACCCAACACACTCACCT | 116 | 2351 |
| 1040453 | 7964 | 7983 | 462217 | 462236 | GACAACCAACACAGCTCAAG | 83 | 2352 |
| 1040485 | 8252 | 8271 | 462505 | 462524 | GTGCTTTATAAAAAGTATA | 94 | 2353 |
| 1040517 | 8613 | 8632 | 462866 | 462885 | TCATTGTTTCAACAGAGCCA | 12 | 2354 |
| 1040549 | 8990 | 9009 | 463243 | 463262 | CGTGTTCAAGATTATATTCT | 49 | 2355 |
| 1040581 | 9345 | 9364 | 463598 | 463617 | AGTTAGCTACCAGAACAGTT | 52 | 2356 |
| 1040613 | 9711 | 9730 | 463964 | 463983 | TGTCACCTAATACTTGGTAT | 25 | 2357 |
| 1040645 | 10211 | 10230 | 464464 | 464483 | GTGCAAAACATCATTCCTTC | 10 | 2358 |
| 1040677 | 10436 | 10455 | 464689 | 464708 | AATTCAATAAACAGACTCGA | 40 | 2359 |
| 1040709 | N/A | N/A | 12342 | 12361 | TTCAGAATTTAAAATTCAGC | 15 | 2360 |
| 1040741 | N/A | N/A | 27434 | 27453 | ACAATTAGCCAAAACTGAAT | 45 | 2361 |
| 1040773 | N/A | N/A | 42923 | 42942 | CGTTCCAAATTATTCCTGCT | 7 | 2362 |
| 1040805 | N/A | N/A | 72788 | 72807 | ATTTGCTCCTTTTATCATTG | 7 | 2363 |
| 1040837 | N/A | N/A | 87598 | 87617 | ACATTATTTCAAAACCCACA | 49 | 2364 |
| 1040869 | N/A | N/A | 110925 | 110944 | TAGTGGTTAGATTAACAGCT | 6 | 2365 |
| 1040901 | N/A | N/A | 141588 | 141607 | GTCTCATAACGATAACCAAA | 23 | 2366 |
| 1040933 | N/A | N/A | 169799 | 169818 | ACCTTTAAAATTTTTCAGC | 94 | 2367 |
| 1040965 | N/A | N/A | 189270 | 189289 | GCTTACAAAGCCATAGAACC | 67 | 2368 |
| 1040997 | N/A | N/A | 209089 | 209108 | GTCTACAGCCTTTAACGACT | 85 | 2369 |
| 1041029 | N/A | N/A | 229753 | 229772 | CCAGTTAACCAAAAAATTTT | 119 | 2370 |
| 1041061 | N/A | N/A | 255397 | 255416 | GGCTACTATCAAATACATTT | 9 | 2371 |
| 1041093 | N/A | N/A | 271117 | 271136 | TGTTTATTTCAAACTTTCCC | 55 | 2372 |
| 1041125 | N/A | N/A | 289433 | 289452 | GGTCTTGGCCCTTAACTGTT | 20 | 2373 |
| 1041157 | N/A | N/A | 319225 | 319244 | CCCTGATAAATTTATGAATT | 50 | 2374 |
| 1041189 | N/A | N/A | 341174 | 341193 | TTTGATCTGCCTTATCTCTG | 14 | 2375 |
| 1041221 | N/A | N/A | 367501 | 367520 | TTTGTATTTTAAACTGAGTG | 5 | 2376 |
| 1041253 | N/A | N/A | 386699 | 386718 | AAGCCAAAATACATCCACC | 46 | 2377 |

TABLE 32-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041285 | N/A | N/A | 414009 | 414028 | CTTTTTAGAATACCATGCCC | 95 | 2378 |
| 1041317 | N/A | N/A | 437788 | 437807 | AATTCATTACACACAGCAGA | 8 | 2379 |
| 1041349 | N/A | N/A | 438226 | 438245 | AAGACATTATATATATGTTG | 89 | 2380 |
| 1041381 | N/A | N/A | 438520 | 438539 | AAGGACAGCCCCTACACCCC | 97 | 2381 |
| 1041413 | N/A | N/A | 439106 | 439125 | CAGATTGTATTAACCACGCT | 5 | 2382 |
| 1041445 | N/A | N/A | 439471 | 439490 | TGTTTTATTTTATCTGAATG | 61 | 2383 |
| 1041477 | N/A | N/A | 440139 | 440158 | CCACCCCTAATTCATGCAGG | 67 | 2384 |
| 1041509 | N/A | N/A | 440364 | 440383 | GCTGCCTTCATTCTCAAGCT | 81 | 2385 |
| 1041541 | N/A | N/A | 441172 | 441191 | GGTGGAGTATTTTAGCTGTG | 10 | 2386 |
| 1041573 | N/A | N/A | 441564 | 441583 | TTATGAGTTCAGGCATCCTC | 15 | 2387 |
| 1041605 | N/A | N/A | 442237 | 442256 | GGCTTTAGTTCCCATGAGGT | 20 | 2388 |
| 1041637 | N/A | N/A | 442682 | 442701 | TTAAGTGGATTATATTTGGC | 11 | 2389 |
| 1041669 | N/A | N/A | 443041 | 443060 | CTAGACTTTCATCAGCTGCC | 53 | 2390 |
| 1041701 | N/A | N/A | 443490 | 443509 | ACCAATACATTTTACAACTC | 34 | 2391 |
| 1041733 | N/A | N/A | 443877 | 443896 | AAGGGACTGACTCTACAGGC | 16 | 2392 |
| 1041765 | N/A | N/A | 444289 | 444308 | GACCTCTCTCTACTTGCTGT | 30 | 2393 |
| 1041797 | N/A | N/A | 445239 | 445258 | TGGGTTTTTCTTACACATGG | 9 | 2394 |
| 1041829 | N/A | N/A | 445574 | 445593 | GTCTTGTTTTACCTGTAGAG | 6 | 2395 |
| 1041861 | N/A | N/A | 445787 | 445806 | CATTTCCTTCACAAGAGTCC | 78 | 2396 |
| 1041893 | N/A | N/A | 446036 | 446055 | CCTAATCTGACTAATGACTG | 94 | 2397 |
| 1041925 | N/A | N/A | 446361 | 446380 | AGGGATGGCCTTTATACTTT | 46 | 2398 |
| 1041957 | N/A | N/A | 446885 | 446904 | AATCATTAAGTCATTTTATG | 79 | 2399 |
| 1041989 | N/A | N/A | 447660 | 447679 | ACTGGTTATCTTCTTATGCA | 120 | 2400 |
| 1042021 | N/A | N/A | 448436 | 448455 | ACTCTCTCCATTCATTTGGA | 52 | 2401 |
| 1042053 | N/A | N/A | 448685 | 448704 | TCTCTTACATCACAAACATC | 94 | 2402 |
| 1042085 | N/A | N/A | 449059 | 449078 | TGAGGGTTCCTAATGATACA | 41 | 2403 |
| 1042117 | N/A | N/A | 449599 | 449618 | GTGAGAATATATATCATCAA | 100 | 2404 |
| 1042149 | N/A | N/A | 449885 | 449904 | CTTGCCAGCCCAATGCTAGT | 95 | 2405 |
| 1042181 | N/A | N/A | 450520 | 450539 | CATAGCTAGAACAGCCTGCC | 107 | 2406 |
| 1042213 | N/A | N/A | 451153 | 451172 | CCCATAAAAACCCTCCAACC | 102 | 2407 |
| 1042245 | N/A | N/A | 451542 | 451561 | GCTAGGATAATTTTATGGCA | 40 | 2408 |
| 1042277 | N/A | N/A | 451926 | 451945 | TATACACACTTCACAGGGCA | 56 | 2409 |
| 1042309 | N/A | N/A | 452223 | 452242 | CAGAAGGAAACCAATCCCAC | 80 | 2410 |
| 1042341 | N/A | N/A | 452473 | 452492 | CAGTGTTTGCCTTATAGCCA | 11 | 2411 |
| 1042373 | N/A | N/A | 452982 | 453001 | AACTTGAGTACATTCATATG | 72 | 2412 |
| 1042405 | N/A | N/A | 453799 | 453818 | TGGAATATCTTTACAGTGCT | 38 | 2413 |

TABLE 32-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042437 | N/A | N/A | 454668 | 454687 | CACTGAAATCAAGAATGCAA | 81 | 2414 |
| 1042469 | N/A | N/A | 455287 | 455306 | TGAATTACTTTCACAATTTT | 73 | 2415 |
| 1042501 | N/A | N/A | 456214 | 456233 | AACTCTGAACAAAAATATAA | 151 | 2416 |
| 1042533 | N/A | N/A | 456961 | 456980 | AGCCACACACTATAAATGAG | 99 | 2417 |

TABLE 33

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040102 | 2217 | 2236 | 436936 | 436955 | CCAGGCTTCCCTAAATGCAG | 92 | 2418 |
| 1040134 | 3141 | 3160 | 457394 | 457413 | ATTCCGTTTTCCTGCTCGGC | 32 | 2419 |
| 1040166 | 3890 | 3909 | 458143 | 458162 | CTGCTCTGAACCCCCCCGGC | 100 | 2420 |
| 1040198 | 4429 | 4448 | 458682 | 458701 | TTGTCCATAGTCATGAACTA | 78 | 2421 |
| 1040230 | 4739 | 4758 | 458992 | 459011 | TTCATAATTCACATTCATCC | 10 | 2422 |
| 1040262 | 5119 | 5138 | 459372 | 459391 | GATGTGGTAAAAAGACCAAA | 38 | 2423 |
| 1040294 | 5459 | 5478 | 459712 | 459731 | ATATTTAAAAATTTCTCCCT | 90 | 2424 |
| 1040326 | 5904 | 5923 | 460157 | 460176 | CCTCTTACCATCAAAGGCTA | 57 | 2425 |
| 1040358 | 6230 | 6249 | 460483 | 460502 | GAGCTTTAACTATATAGCAC | 44 | 2426 |
| 1040390 | 7045 | 7064 | 461298 | 461317 | TTCGCCCTGACTAATTTCTT | 25 | 2427 |
| 1040422 | 7450 | 7469 | 461703 | 461722 | GGATGCTGCCACTTCCTGGT | 66 | 2428 |
| 1040454 | 7968 | 7987 | 462221 | 462240 | CCATGACAACCAACACAGCT | 131 | 2429 |
| 1040486 | 8278 | 8297 | 462531 | 462550 | CCAACCCAACACAATAGCAG | 33 | 2430 |
| 1040518 | 8615 | 8634 | 462868 | 462887 | ACTCATTGTTTCAACAGAGC | 27 | 2431 |
| 1040550 | 9008 | 9027 | 463261 | 463280 | CCCTTGTTACAAACACTTCG | 65 | 2432 |
| 1040582 | 9369 | 9388 | 463622 | 463641 | CCCTCCCGCCATTACACAGG | 83 | 2433 |
| 1040614 | 9714 | 9733 | 463967 | 463986 | TAGTGTCACCTAATACTTGG | 59 | 2434 |
| 1040646 | 10212 | 10231 | 464465 | 464484 | GGTGCAAAACATCATTCCTT | 21 | 2435 |
| 1040678 | 10442 | 10461 | 464695 | 464714 | CCATAAAATTCAATAAACAG | 108 | 2436 |
| 1040710 | N/A | N/A | 13427 | 13446 | ATAAGCTTTCTTTAAATGCA | 9 | 2437 |
| 1040742 | N/A | N/A | 27656 | 27675 | GTGTTCTTTCTTTAACAGTT | 4 | 2438 |
| 1040774 | N/A | N/A | 42927 | 42946 | CCCCCGTTCCAAATTATTCC | 106 | 2439 |
| 1040806 | N/A | N/A | 74008 | 74027 | GTTTTTATCCATTACAAGAG | 22 | 2440 |
| 1040838 | N/A | N/A | 88730 | 88749 | ACCCGCAATCAAATACTGCC | 73 | 2441 |

TABLE 33-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040870 | N/A | N/A | 111213 | 111232 | CTAATGTGCCCTTAACATGG | 95 | 2442 |
| 1040902 | N/A | N/A | 141663 | 141682 | GCTCATAAACCATGTGCTC | 100 | 2443 |
| 1040934 | N/A | N/A | 170327 | 170346 | GCTTGATTTTAAACTTTATA | 40 | 2444 |
| 1040966 | N/A | N/A | 190544 | 190563 | ACCCTCAAACGAATAGGCTC | 145 | 2445 |
| 1040998 | N/A | N/A | 209796 | 209815 | TCCACACAAGAATAATCTAC | 86 | 2446 |
| 1041030 | N/A | N/A | 230401 | 230420 | GCTAGGAAAATTTACCATAC | 29 | 2447 |
| 1041062 | N/A | N/A | 255626 | 255645 | GATTAAATAATTTAAGCACA | 110 | 2448 |
| 1041094 | N/A | N/A | 271334 | 271353 | TCTTGGGTTCCTTATATTAC | 56 | 2449 |
| 1041126 | N/A | N/A | 290352 | 290371 | TAGGTGTTTATTTAGAACCC | 12 | 2450 |
| 1041158 | N/A | N/A | 319445 | 319464 | TCATGCTTTCAAAACACAGT | 11 | 2451 |
| 1041190 | N/A | N/A | 342628 | 342647 | AATGAAATCATTTACTGAAC | 85 | 2452 |
| 1041222 | N/A | N/A | 368463 | 368482 | AGTGTAATACATTACTCATA | 5 | 2453 |
| 1041254 | N/A | N/A | 387051 | 387070 | GTATACAAAGATATAACCTG | 76 | 2454 |
| 1041286 | N/A | N/A | 418439 | 418458 | TGTTTGTTTTAAAATTAGGG | 72 | 2455 |
| 1041318 | N/A | N/A | 437792 | 437811 | GGTTAATTCATTACACACAG | 3 | 2456 |
| 1041350 | N/A | N/A | 438237 | 438256 | ACCTAAATAATAAGACATTA | 141 | 2457 |
| 1041382 | N/A | N/A | 438532 | 438551 | AGCCAGACAACTAAGGACAG | 80 | 2458 |
| 1041414 | N/A | N/A | 439107 | 439126 | TCAGATTGTATTAACCACGC | 5 | 2459 |
| 1041446 | N/A | N/A | 439472 | 439491 | TTGTTTTATTTTATCTGAAT | 95 | 2460 |
| 1041478 | N/A | N/A | 440143 | 440162 | GTACCCACCCCTAATTCATG | 119 | 2461 |
| 1041510 | N/A | N/A | 440366 | 440385 | TGGCTGCCTTCATTCTCAAG | 106 | 2462 |
| 1041542 | N/A | N/A | 441188 | 441207 | TGTGGCAAACACAGCTGGTG | 45 | 2463 |
| 1041574 | N/A | N/A | 441611 | 441630 | ATACTATATCACACTGCTTT | 58 | 2464 |
| 1041606 | N/A | N/A | 442251 | 442270 | GTTTTATATGCCATGGCTTT | 58 | 2465 |
| 1041638 | N/A | N/A | 442691 | 442710 | TGGAGGATATTAAGTGGATT | 22 | 2466 |
| 1041670 | N/A | N/A | 443042 | 443061 | TCTAGACTTTCATCAGCTGC | 66 | 2467 |
| 1041702 | N/A | N/A | 443492 | 443511 | TTACCAATACATTTTACAAC | 72 | 2468 |
| 1041734 | N/A | N/A | 443917 | 443936 | GGCATGTTCAATGTTGGCAA | 16 | 2469 |
| 1041766 | N/A | N/A | 444314 | 444333 | ACAGGGAAAACTGTTAGGTG | 7 | 2470 |
| 1041798 | N/A | N/A | 445240 | 445259 | CTGGGTTTTCTTACACATG | 10 | 2471 |
| 1041830 | N/A | N/A | 445576 | 445595 | CAGTCTTGTTTTACCTGTAG | 6 | 2472 |
| 1041862 | N/A | N/A | 445791 | 445810 | CTCCCATTTCCTTCACAAGA | 53 | 2473 |
| 1041894 | N/A | N/A | 446044 | 446063 | GTCACCTTCCTAATCTGACT | 106 | 2474 |
| 1041926 | N/A | N/A | 446679 | 446698 | CCTTTATAACTTTTCTTTCT | 28 | 2475 |
| 1041958 | N/A | N/A | 446891 | 446910 | GTTAGTAATCATTAAGTCAT | 5 | 2476 |
| 1041990 | N/A | N/A | 447677 | 447696 | CCCTGGTGCCAAAAGGGACT | 100 | 2477 |

TABLE 33-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042022 | N/A | N/A | 448475 | 448494 | TCTTTAACCCCTCTTGCGCC | 123 | 2478 |
| 1042054 | N/A | N/A | 448687 | 448706 | TTTCTCTTACATCACAAACA | 116 | 2479 |
| 1042086 | N/A | N/A | 449060 | 449079 | TTGAGGGTTCCTAATGATAC | 54 | 2480 |
| 1042118 | N/A | N/A | 449600 | 449619 | AGTGAGAATATATATCATCA | 122 | 2481 |
| 1042150 | N/A | N/A | 449916 | 449935 | AATCTGATCATTGTAGGCAC | 12 | 2482 |
| 1042182 | N/A | N/A | 450530 | 450549 | TGGTGTGAACCATAGCTAGA | 120 | 2483 |
| 1042214 | N/A | N/A | 451161 | 451180 | ACCCCCCTCCCATAAAAACC | 117 | 2484 |
| 1042246 | N/A | N/A | 451566 | 451585 | GGTTTTACCCTTTCCTGCAC | 90 | 2485 |
| 1042278 | N/A | N/A | 451931 | 451950 | CACATTATACACACTTCACA | 78 | 2486 |
| 1042310 | N/A | N/A | 452244 | 452263 | TCATTAACAACATAAACTGA | 74 | 2487 |
| 1042342 | N/A | N/A | 452495 | 452514 | CATGGTACAGATAATTGTGA | 57 | 2488 |
| 1042374 | N/A | N/A | 453018 | 453037 | TACTGGATCCATACAAGGCA | 33 | 2489 |
| 1042406 | N/A | N/A | 453800 | 453819 | ATGGAATATCTTTACAGTGC | 17 | 2490 |
| 1042438 | N/A | N/A | 454669 | 454688 | CCACTGAAATCAAGAATGCA | 121 | 2491 |
| 1042470 | N/A | N/A | 455290 | 455309 | TCTTGAATTACTTTCACAAT | 24 | 2492 |
| 1042502 | N/A | N/A | 456227 | 456246 | GAGGACAACTAAAAACTCTG | 105 | 2493 |
| 1042534 | N/A | N/A | 456962 | 456981 | CAGCCACACACTATAAATGA | 112 | 2494 |

TABLE 34

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040103 | 2218 | 2237 | 436937 | 436956 | GCCAGGCTTCCCTAAATGCA | 135 | 2495 |
| 1040135 | 3180 | 3199 | 457433 | 457452 | TCGCCATTCTCAGAGAGCAT | 79 | 2496 |
| 1040167 | 3909 | 3928 | 458162 | 458181 | TGGGAACCCCAGGAGGACAC | 54 | 2497 |
| 1040199 | 4484 | 4503 | 458737 | 458756 | ATCTAATTCCTCATGTCACA | 15 | 2498 |
| 1040231 | 4740 | 4759 | 458993 | 459012 | GTTCATAATTCACATTCATC | 8 | 2499 |
| 1040263 | 5161 | 5180 | 459414 | 459433 | CAGAGTTTCTAAGAGCCCGC | 38 | 2500 |
| 1040295 | 5460 | 5479 | 459713 | 459732 | AATATTTAAAAATTTCTCCC | 110 | 2501 |
| 1040327 | 5906 | 5925 | 460159 | 460178 | TTCCTCTTACCATCAAAGGC | 38 | 2502 |
| 1040359 | 6232 | 6251 | 460485 | 460504 | ATGAGCTTTAACTATATAGC | 31 | 2503 |
| 1040391 | 7049 | 7068 | 461302 | 461321 | TCTTTTCGCCCTGACTAATT | 32 | 2504 |
| 1040423 | 7495 | 7514 | 461748 | 461767 | AAGAGGTGTGAAAGGTTCCG | 27 | 2505 |
| 1040455 | 7969 | 7988 | 462222 | 462241 | GCCATGACAACCAACACAGC | 96 | 2506 |

TABLE 34-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040487 | 8283 | 8302 | 462536 | 462555 | GGAAACCAACCCAACACAAT | 73 | 2507 |
| 1040519 | 8662 | 8681 | 462915 | 462934 | ACTTTCAACCCTTCTCTGCT | 53 | 2508 |
| 1040551 | 9010 | 9029 | 463263 | 463282 | ATCCCTTGTTACAAACACTT | 33 | 2509 |
| 1040583 | 9370 | 9389 | 463623 | 463642 | TCCCTCCCGCCATTACACAG | 94 | 2510 |
| 1040615 | 9719 | 9738 | 463972 | 463991 | TGAGCTAGTGTCACCTAATA | 12 | 2511 |
| 1040647 | 10213 | 10232 | 464466 | 464485 | AGGTGCAAAACATCATTCCT | 36 | 2512 |
| 1040679 | 10447 | 10466 | 464700 | 464719 | AGGGACCATAAAATTCAATA | 22 | 2513 |
| 1040711 | N/A | N/A | 14141 | 14160 | CTCCTCCAAATTTATCTTCA | 56 | 2514 |
| 1040743 | N/A | N/A | 28302 | 28321 | CACAAAATACATTAAGTCCT | 27 | 2515 |
| 1040775 | N/A | N/A | 43117 | 43136 | TCCAGCAAAATATTTCTTTA | 39 | 2516 |
| 1040807 | N/A | N/A | 74082 | 74101 | TTGATCAACCAAAGATGGCT | 39 | 2517 |
| 1040839 | N/A | N/A | 88777 | 88796 | CCAATGGCTTTTTAACAGAT | 27 | 2518 |
| 1040871 | N/A | N/A | 112988 | 113007 | AACACATTAGATTATGAGTA | 11 | 2519 |
| 1040903 | N/A | N/A | 141741 | 141760 | AGGGTGTTATTTTAGAGTAA | 13 | 2520 |
| 1040935 | N/A | N/A | 171157 | 171176 | GCTGGAAAAGAATCTGAGCA | 114 | 2521 |
| 1040967 | N/A | N/A | 190616 | 190635 | GTTATATTATTTTATCCCTT | 14 | 2522 |
| 1040999 | N/A | N/A | 209931 | 209950 | GAAGATATCTTTTATGACAC | 23 | 2523 |
| 1041031 | N/A | N/A | 231711 | 231730 | CACAGTAGCCAAAAGCAGTC | 95 | 2524 |
| 1041063 | N/A | N/A | 255652 | 255671 | GTATATATTATTTAAAATGT | 101 | 2525 |
| 1041095 | N/A | N/A | 273041 | 273060 | AGCTGGTTTCTTTAGCCACC | 81 | 2526 |
| 1041127 | N/A | N/A | 290740 | 290759 | GACTGAAAAATACCCAGCCA | 102 | 2527 |
| 1041159 | N/A | N/A | 322660 | 322679 | TAGGCCTTATTTTATTCCAT | 72 | 2528 |
| 1041191 | N/A | N/A | 342814 | 342833 | TGAGCTTTTTAAAAACAGTT | 4 | 2529 |
| 1041223 | N/A | N/A | 369251 | 369270 | TTTCTTAGCCAAAGAGATAT | 85 | 2530 |
| 1041255 | N/A | N/A | 387144 | 387163 | TGTTCAATTTAAAAGCCTTG | 5 | 2531 |
| 1041287 | N/A | N/A | 418795 | 418814 | ATCTGCAAAGAATCTGCCCC | 72 | 2532 |
| 1041319 | N/A | N/A | 437793 | 437812 | AGGTTAATTCATTACACACA | 5 | 2533 |
| 1041351 | N/A | N/A | 438241 | 438260 | TCATACCTAAATAATAAGAC | 102 | 2534 |
| 1041383 | N/A | N/A | 438533 | 438552 | CAGCCAGACAACTAAGGACA | 57 | 2535 |
| 1041415 | N/A | N/A | 439116 | 439135 | CCTGACTTCTCAGATTGTAT | 50 | 2536 |
| 1041447 | N/A | N/A | 439505 | 439524 | ATTCAAACCATTAATTAGTT | 73 | 2537 |
| 1041479 | N/A | N/A | 440144 | 440163 | AGTACCCACCCCTAATTCAT | 98 | 2538 |
| 1041511 | N/A | N/A | 440368 | 440387 | AGTGGCTGCCTTCATTCTCA | 52 | 2539 |
| 1041543 | N/A | N/A | 441206 | 441225 | GACTCTGAACCTGTCACTTG | 83 | 2540 |
| 1041575 | N/A | N/A | 441613 | 441632 | CCATACTATATCACACTGCT | 21 | 2541 |
| 1041607 | N/A | N/A | 442255 | 442274 | CTCAGTTTTATATGCCATGG | 44 | 2542 |

TABLE 34-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041639 | N/A | N/A | 442692 | 442711 | TTGGAGGATATTAAGTGGAT | 14 | 2543 |
| 1041671 | N/A | N/A | 443043 | 443062 | TTCTAGACTTTCATCAGCTG | 102 | 2544 |
| 1041703 | N/A | N/A | 443494 | 443513 | CTTTACCAATACATTTTACA | 61 | 2545 |
| 1041735 | N/A | N/A | 443936 | 443955 | ATTCATCGCCACCAAGCTCG | 48 | 2546 |
| 1041767 | N/A | N/A | 444343 | 444362 | ATCTATCACACCAATGCAAG | 29 | 2547 |
| 1041799 | N/A | N/A | 445241 | 445260 | GCTGGGTTTTCTTACACAT | 25 | 2548 |
| 1041831 | N/A | N/A | 445587 | 445606 | AGTGAAATTCTCAGTCTTGT | 37 | 2549 |
| 1041863 | N/A | N/A | 445806 | 445825 | GTTGTTTAAATATGTCTCCC | 8 | 2550 |
| 1041895 | N/A | N/A | 446045 | 446064 | TGTCACCTTCCTAATCTGAC | 51 | 2551 |
| 1041927 | N/A | N/A | 446680 | 446699 | GCCTTTATAACTTTTCTTTC | 11 | 2552 |
| 1041959 | N/A | N/A | 446892 | 446911 | TGTTAGTAATCATTAAGTCA | 12 | 2553 |
| 1041991 | N/A | N/A | 447705 | 447724 | CCAAAAAATCTTCTTCCATG | 45 | 2554 |
| 1042023 | N/A | N/A | 448476 | 448495 | TTCTTTAACCCCTCTTGCGC | 94 | 2555 |
| 1042055 | N/A | N/A | 448712 | 448731 | CTTGGAATCATACTTTCTTC | 55 | 2556 |
| 1042087 | N/A | N/A | 449061 | 449080 | ATTGAGGGTTCCTAATGATA | 46 | 2557 |
| 1042119 | N/A | N/A | 449602 | 449621 | TCAGTGAGAATATATATCAT | 98 | 2558 |
| 1042151 | N/A | N/A | 449921 | 449940 | CAGATAATCTGATCATTGTA | 45 | 2559 |
| 1042183 | N/A | N/A | 450531 | 450550 | GTGGTGTGAACCATAGCTAG | 97 | 2560 |
| 1042215 | N/A | N/A | 451169 | 451188 | CCCCCCATACCCCCCTCCCA | 92 | 2561 |
| 1042247 | N/A | N/A | 451567 | 451586 | GGGTTTTACCCTTTCCTGCA | 99 | 2562 |
| 1042279 | N/A | N/A | 451933 | 451952 | GCCACATTATACACACTTCA | 13 | 2563 |
| 1042311 | N/A | N/A | 452245 | 452264 | GTCATTAACAACATAAACTG | 21 | 2564 |
| 1042343 | N/A | N/A | 452496 | 452515 | CCATGGTACAGATAATTGTG | 105 | 2565 |
| 1042375 | N/A | N/A | 453045 | 453064 | CTGATACATTTCTAGAATGA | 28 | 2566 |
| 1042407 | N/A | N/A | 453852 | 453871 | TCACAGTTTACATCTCAACA | 28 | 2567 |
| 1042439 | N/A | N/A | 454686 | 454705 | TAGAATTAAAATATACACCA | 69 | 2568 |
| 1042471 | N/A | N/A | 455291 | 455310 | GTCTTGAATTACTTTCACAA | 9 | 2569 |
| 1042503 | N/A | N/A | 456245 | 456264 | TGGACCAACCCTCCTTCTGA | 81 | 2570 |
| 1042535 | N/A | N/A | 456967 | 456986 | TCCCCCAGCCACACACTATA | 102 | 2571 |

TABLE 35

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 1 | 138 |
| 1040104 | 2348 | 2367 | 437067 | 437086 | TCAGGTAGCCGATGACAGGG | 44 | 2572 |
| 1040136 | 3181 | 3200 | 457434 | 457453 | TTCGCCATTCTCAGAGAGCA | 57 | 2573 |
| 1040168 | 3937 | 3956 | 458190 | 458209 | GCTGGGTTCCTGATGTTGAT | 31 | 2574 |
| 1040200 | 4485 | 4504 | 458738 | 458757 | AATCTAATTCCTCATGTCAC | 21 | 2575 |
| 1040232 | 4741 | 4760 | 458994 | 459013 | AGTTCATAATTCACATTCAT | 13 | 2576 |
| 1040264 | 5162 | 5181 | 459415 | 459434 | TCAGAGTTTCTAAGAGCCCG | 17 | 2577 |
| 1040296 | 5477 | 5496 | 459730 | 459749 | GCAGCCATCCAAGTAAGAAT | 16 | 2578 |
| 1040328 | 5913 | 5932 | 460166 | 460185 | GCCCGTATTCCTCTTACCAT | 12 | 2579 |
| 1040360 | 6268 | 6287 | 460521 | 460540 | GGAAGATCAACCAAACAAGG | 46 | 2580 |
| 1040392 | 7061 | 7080 | 461314 | 461333 | GTATTATTTTTTCTTTTCG | 11 | 2581 |
| 1040424 | 7563 | 7582 | 461816 | 461835 | CAGAGCAGTCAAAGTGCTGC | 118 | 2582 |
| 1040456 | 7970 | 7989 | 462223 | 462242 | AGCCATGACAACCAACACAG | 63 | 2583 |
| 1040488 | 8289 | 8308 | 462542 | 462561 | AAGAGAGGAAACCAACCCAA | 50 | 2584 |
| 1040520 | 8663 | 8682 | 462916 | 462935 | AACTTTCAACCCTTCTCTGC | 37 | 2585 |
| 1040552 | 9040 | 9059 | 463293 | 463312 | ATAATGAGTCCTGTTTGATT | 20 | 2586 |
| 1040584 | 9377 | 9396 | 463630 | 463649 | CCGGTGTTCCCTCCCGCCAT | 85 | 2587 |
| 1040616 | 9772 | 9791 | 464025 | 464044 | CAGAGAAAACCTGTGCACCG | 71 | 2588 |
| 1040648 | 10214 | 10233 | 464467 | 464486 | AAGGTGCAAAACATCATTCC | 35 | 2589 |
| 1040680 | 10463 | 10482 | 464716 | 464735 | AAGCACCATCAAAGAAAGGG | 24 | 2590 |
| 1040712 | N/A | N/A | 14174 | 14193 | ACCCAATTTCAAAGATCACT | 29 | 2591 |
| 1040744 | N/A | N/A | 28305 | 28324 | GTTCACAAAATACATTAAGT | 6 | 2592 |
| 1040776 | N/A | N/A | 43918 | 43937 | AGATCAATTCAAAGGCTCCT | 62 | 2593 |
| 1040808 | N/A | N/A | 74369 | 74388 | GATTTGTATTTTTAATTGAC | 58 | 2594 |
| 1040840 | N/A | N/A | 89862 | 89881 | TTGACATTTTAAAACAGCTC | 40 | 2595 |
| 1040872 | N/A | N/A | 114285 | 114304 | AAGCTTATCCAAAAACATTT | 70 | 2596 |
| 1040904 | N/A | N/A | 143859 | 143878 | CCCCTCAACCAAACTTTTAC | 116 | 2597 |
| 1040936 | N/A | N/A | 172540 | 172559 | TATTAATTTCATTACCATGA | 92 | 2598 |
| 1040968 | N/A | N/A | 190768 | 190787 | CCTAGAATACATTATTCCTC | 56 | 2599 |
| 1041000 | N/A | N/A | 209947 | 209966 | AGCATATTTAAAGAAGAAG | 76 | 2600 |
| 1041032 | N/A | N/A | 233011 | 233030 | GTCCATACACCTTAATAAGT | 29 | 2601 |
| 1041064 | N/A | N/A | 256096 | 256115 | GATTACTTTTAAAAGCAACA | 54 | 2602 |
| 1041096 | N/A | N/A | 273624 | 273643 | CCTAAAAGAATTTATCCATA | 96 | 2603 |
| 1041128 | N/A | N/A | 290841 | 290860 | CTTGGCAAATTATTATCTGC | 12 | 2604 |
| 1041160 | N/A | N/A | 322672 | 322691 | GCTAAGAAAATATAGGCCTT | 73 | 2605 |
| 1041192 | N/A | N/A | 343258 | 343277 | GGCTTTATAGTCTAAGTTGC | 7 | 2606 |

TABLE 35-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041224 | N/A | N/A | 369453 | 369472 | ACTTCAAACCTTTATCAGTT | 3 | 2607 |
| 1041256 | N/A | N/A | 388260 | 388279 | CAAACCCAAATTTAGCTCTG | 41 | 2608 |
| 1041288 | N/A | N/A | 420471 | 420490 | CCTTTAAGCCCTTAAAGCTG | 110 | 2609 |
| 1041320 | N/A | N/A | 437794 | 437813 | GAGGTTAATTCATTACACAC | 5 | 2610 |
| 1041352 | N/A | N/A | 438248 | 438267 | GGCCTTATCATACCTAAATA | 61 | 2611 |
| 1041384 | N/A | N/A | 438538 | 438557 | ACCAGCAGCCAGACAACTAA | 66 | 2612 |
| 1041416 | N/A | N/A | 439148 | 439167 | TACCCCAAGCCCAGCAGGTC | 108 | 2613 |
| 1041448 | N/A | N/A | 439513 | 439532 | CCAAAACAATTCAAACCATT | 40 | 2614 |
| 1041480 | N/A | N/A | 440152 | 440171 | TTTCTCCTAGTACCCACCCC | 78 | 2615 |
| 1041512 | N/A | N/A | 440369 | 440388 | AAGTGGCTGCCTTCATTCTC | 44 | 2616 |
| 1041544 | N/A | N/A | 441287 | 441306 | GGAACCTCAATTAAGTCCAG | 38 | 2617 |
| 1041576 | N/A | N/A | 441615 | 441634 | CACCATACTATATCACACTG | 29 | 2618 |
| 1041608 | N/A | N/A | 442256 | 442275 | CCTCAGTTTTATATGCCATG | 6 | 2619 |
| 1041640 | N/A | N/A | 442706 | 442725 | TTATGGCCTCAAACTTGGAG | 53 | 2620 |
| 1041672 | N/A | N/A | 443046 | 443065 | TCTTTCTAGACTTTCATCAG | 33 | 2621 |
| 1041704 | N/A | N/A | 443496 | 443515 | CACTTTACCAATACATTTTA | 80 | 2622 |
| 1041736 | N/A | N/A | 443941 | 443960 | TTAGGATTCATCGCCACCAA | 19 | 2623 |
| 1041768 | N/A | N/A | 444346 | 444365 | CCAATCTATCACACCAATGC | 24 | 2624 |
| 1041800 | N/A | N/A | 445254 | 445273 | TCCCACATTAAAAGCTGGGT | 109 | 2625 |
| 1041832 | N/A | N/A | 445593 | 445612 | TCTGCAAGTGAAATTCTCAG | 66 | 2626 |
| 1041864 | N/A | N/A | 445849 | 445868 | GTACATATCACCAAAAACAA | 57 | 2627 |
| 1041896 | N/A | N/A | 446046 | 446065 | ATGTCACCTTCCTAATCTGA | 26 | 2628 |
| 1041928 | N/A | N/A | 446684 | 446703 | AATAGCCTTTATAACTTTTC | 18 | 2629 |
| 1041960 | N/A | N/A | 446894 | 446913 | TGTGTTAGTAATCATTAAGT | 19 | 2630 |
| 1041992 | N/A | N/A | 447708 | 447727 | CTGCCAAAAATCTTCTTCC | 50 | 2631 |
| 1042024 | N/A | N/A | 448482 | 448501 | TGCTGGTTCTTTAACCCCTC | 40 | 2632 |
| 1042056 | N/A | N/A | 448729 | 448748 | GCTGTTCAATCAAGCACCTT | 76 | 2633 |
| 1042088 | N/A | N/A | 449072 | 449091 | CTCAAAATATTATTGAGGGT | 35 | 2634 |
| 1042120 | N/A | N/A | 449604 | 449623 | TCTCAGTGAGAATATATATC | 103 | 2635 |
| 1042152 | N/A | N/A | 449922 | 449941 | TCAGATAATCTGATCATTGT | 54 | 2636 |
| 1042184 | N/A | N/A | 450547 | 450566 | CTTAGAATTAAATGCTGTGG | 63 | 2637 |
| 1042216 | N/A | N/A | 451173 | 451192 | GTCTCCCCCATACCCCCCT | 81 | 2638 |
| 1042248 | N/A | N/A | 451670 | 451689 | AACTCCAAAGACACCACTCT | 86 | 2639 |
| 1042280 | N/A | N/A | 451934 | 451953 | AGCCACATTATACACACTTC | 16 | 2640 |
| 1042312 | N/A | N/A | 452252 | 452271 | TCTTAGAGTCATTAACAACA | 15 | 2641 |
| 1042344 | N/A | N/A | 452506 | 452525 | TGGGCTTGTTCCATGGTACA | 42 | 2642 |

TABLE 35-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042376 | N/A | N/A | 453046 | 453065 | TCTGATACATTTCTAGAATG | 36 | 2643 |
| 1042408 | N/A | N/A | 453854 | 453873 | ACTCACAGTTTACATCTCAA | 16 | 2644 |
| 1042440 | N/A | N/A | 454687 | 454706 | GTAGAATTAAAATATACACC | 17 | 2645 |
| 1042472 | N/A | N/A | 455293 | 455312 | AGGTCTTGAATTACTTTCAC | 7 | 2646 |
| 1042504 | N/A | N/A | 456246 | 456265 | TTGGACCAACCCTCCTTCTG | 114 | 2647 |
| 1042536 | N/A | N/A | 456983 | 457002 | TTTGCAAACCTCCCTCTCCC | 106 | 2648 |

TABLE 36

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040105 | 2350 | 2369 | 437069 | 437088 | GCTCAGGTAGCCGATGACAG | 84 | 2649 |
| 1040137 | 3185 | 3204 | 457438 | 457457 | TCAGTTCGCCATTCTCAGAG | 68 | 2650 |
| 1040169 | 3938 | 3957 | 458191 | 458210 | AGCTGGGTTCCTGATGTTGA | 45 | 2651 |
| 1040201 | 4488 | 4507 | 458741 | 458760 | CAAAATCTAATTCCTCATGT | 61 | 2652 |
| 1040233 | 4742 | 4761 | 458995 | 459014 | TAGTTCATAATTCACATTCA | 19 | 2653 |
| 1040265 | 5163 | 5182 | 459416 | 459435 | CTCAGAGTTTCTAAGAGCCC | 27 | 2654 |
| 1040297 | 5481 | 5500 | 459734 | 459753 | AGTTGCAGCCATCCAAGTAA | 26 | 2655 |
| 1040329 | 5914 | 5933 | 460167 | 460186 | AGCCCGTATTCCTCTTACCA | 22 | 2656 |
| 1040361 | 6269 | 6288 | 460522 | 460541 | GGGAAGATCAACCAAACAAG | 37 | 2657 |
| 1040393 | 7076 | 7095 | 461329 | 461348 | GGTTTCTTATTAATAGTATT | 23 | 2658 |
| 1040425 | 7575 | 7594 | 461828 | 461847 | ACAACCCTACTCCAGAGCAG | 59 | 2659 |
| 1040457 | 7976 | 7995 | 462229 | 462248 | AACAGTAGCCATGACAACCA | 80 | 2660 |
| 1040489 | 8317 | 8336 | 462570 | 462589 | TGCCAGAAACACAACACTGT | 88 | 2661 |
| 1040521 | 8668 | 8687 | 462921 | 462940 | CATGTAACTTTCAACCCTTC | 28 | 2662 |
| 1040553 | 9050 | 9069 | 463303 | 463322 | TTTTGTCCCCATAATGAGTC | 47 | 2663 |
| 1040585 | 9393 | 9412 | 463646 | 463665 | ACATGAAAAACTGAAGCCGG | 67 | 2664 |
| 1040617 | 9815 | 9834 | 464068 | 464087 | CCTGGGCCAGAAAACTGAAA | 131 | 2665 |
| 1040649 | 10226 | 10245 | 464479 | 464498 | TTTCTTTTCAATAAGGTGCA | 14 | 2666 |
| 1040681 | 10476 | 10495 | 464729 | 464748 | CTAGAAAACCTGCAAGCACC | 32 | 2667 |
| 1040713 | N/A | N/A | 14562 | 14581 | GCTGAATTCAAACGCAGCA | 96 | 2668 |
| 1040745 | N/A | N/A | 28358 | 28377 | GCAGTAATTTAAAGTATGAA | 35 | 2669 |
| 1040777 | N/A | N/A | 44806 | 44825 | AACAAATTTTAAAGCTCTTT | 36 | 2670 |
| 1040809 | N/A | N/A | 75467 | 75486 | AGCATCAACCAAATTCAGTA | 20 | 2671 |

TABLE 36-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040841 | N/A | N/A | 91912 | 91931 | CCCTGACCTATTTAACATAC | 135 | 2672 |
| 1040873 | N/A | N/A | 114340 | 114359 | CTGTTTAACCAAAAACATCT | 85 | 2673 |
| 1040905 | N/A | N/A | 144629 | 144648 | ATCACTAAACGATAGCACAA | 102 | 2674 |
| 1040937 | N/A | N/A | 172695 | 172714 | AACTCCTTTTAAATTGAATT | 111 | 2675 |
| 1040969 | N/A | N/A | 193065 | 193084 | GGGATTAAATAATTATGTGC | 13 | 2676 |
| 1041001 | N/A | N/A | 209950 | 209969 | GCTAGCATATTTTAAAGAAG | 138 | 2677 |
| 1041033 | N/A | N/A | 233976 | 233995 | CCAGCATTTCAAAGAGCAAC | 69 | 2678 |
| 1041065 | N/A | N/A | 256246 | 256265 | GGCATGTTTATATAACAGCC | 124 | 2679 |
| 1041097 | N/A | N/A | 273626 | 273645 | TTCCTAAAAGAATTTATCCA | 108 | 2680 |
| 1041129 | N/A | N/A | 291710 | 291729 | GTTTCAATATTTTATGCAAA | 3 | 2681 |
| 1041161 | N/A | N/A | 322739 | 322758 | GCAGTAATAATTTAGCCAAA | 5 | 2682 |
| 1041193 | N/A | N/A | 343540 | 343559 | GCTATTAGACAATATAGAGT | 2 | 2683 |
| 1041225 | N/A | N/A | 369454 | 369473 | CACTTCAAACCTTTATCAGT | 30 | 2684 |
| 1041257 | N/A | N/A | 389567 | 389586 | AATCCTTTAATTTAACAACC | 111 | 2685 |
| 1041289 | N/A | N/A | 423903 | 423922 | CCATGAAGAATTTAACCTCA | 90 | 2686 |
| 1041321 | N/A | N/A | 437795 | 437814 | GGAGGTTAATTCATTACACA | 6 | 2687 |
| 1041353 | N/A | N/A | 438249 | 438268 | TGGCCTTATCATACCTAAAT | 80 | 2688 |
| 1041385 | N/A | N/A | 438553 | 438572 | ATTGATCACCCCAGCACCAG | 88 | 2689 |
| 1041417 | N/A | N/A | 439149 | 439168 | TTACCCCAAGCCCAGCAGGT | 95 | 2690 |
| 1041449 | N/A | N/A | 439514 | 439533 | CCCAAAACAATTCAAACCAT | 69 | 2691 |
| 1041481 | N/A | N/A | 440158 | 440177 | ATTTTCTTTCTCCTAGTACC | 69 | 2692 |
| 1041513 | N/A | N/A | 440406 | 440425 | AGAGGCTGCCAGGCCTGGGA | 106 | 2693 |
| 1041545 | N/A | N/A | 441288 | 441307 | TGGAACCTCAATTAAGTCCA | 75 | 2694 |
| 1041577 | N/A | N/A | 441617 | 441636 | ACCACCATACTATATCACAC | 37 | 2695 |
| 1041609 | N/A | N/A | 442257 | 442276 | CCCTCAGTTTTATATGCCAT | 17 | 2696 |
| 1041641 | N/A | N/A | 442708 | 442727 | ACTTATGGCCTCAAACTTGG | 63 | 2697 |
| 1041673 | N/A | N/A | 443057 | 443076 | AAGTTCAGCCTTCTTTCTAG | 28 | 2698 |
| 1041705 | N/A | N/A | 443498 | 443517 | AGCACTTTACCAATACATTT | 46 | 2699 |
| 1041737 | N/A | N/A | 443961 | 443980 | ACTATCTATTTTTGATACA | 63 | 2700 |
| 1041769 | N/A | N/A | 444350 | 444369 | GTAACCAATCTATCACACCA | 20 | 2701 |
| 1041801 | N/A | N/A | 445255 | 445274 | ATCCCACATTAAAAGCTGGG | 121 | 2702 |
| 1041833 | N/A | N/A | 445608 | 445627 | GCATTCTTAACTTTGTCTGC | 47 | 2703 |
| 1041865 | N/A | N/A | 445874 | 445893 | GTGCTATGTCTATATACACA | 71 | 2704 |
| 1041897 | N/A | N/A | 446067 | 446086 | GGGCTCATAATTATTTTTA | 103 | 2705 |
| 1041929 | N/A | N/A | 446685 | 446704 | GAATAGCCTTTATAACTTTT | 12 | 2706 |
| 1041961 | N/A | N/A | 446928 | 446947 | TCAGTTATTTTCTCTCCACT | 9 | 2707 |

TABLE 36-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041993 | N/A | N/A | 447709 | 447728 | CCTGCCAAAAAATCTTCTTC | 127 | 2708 |
| 1042025 | N/A | N/A | 448483 | 448502 | TTGCTGGTTCTTTAACCCCT | 31 | 2709 |
| 1042057 | N/A | N/A | 448731 | 448750 | CGGCTGTTCAATCAAGCACC | 85 | 2710 |
| 1042089 | N/A | N/A | 449073 | 449092 | CCTCAAATATTATTGAGGG | 153 | 2711 |
| 1042121 | N/A | N/A | 449627 | 449646 | TGAAGAAATCTCACTGAGGG | 149 | 2712 |
| 1042153 | N/A | N/A | 449929 | 449948 | AGATTATTCAGATAATCTGA | 125 | 2713 |
| 1042185 | N/A | N/A | 450548 | 450567 | CCTTAGAATTAAATGCTGTG | 84 | 2714 |
| 1042217 | N/A | N/A | 451193 | 451212 | TCCTCGATACTAACCCCTTC | 93 | 2715 |
| 1042249 | N/A | N/A | 451674 | 451693 | TCAAAACTCCAAAGACACCA | 67 | 2716 |
| 1042281 | N/A | N/A | 451935 | 451954 | GAGCCACATTATACACACTT | 30 | 2717 |
| 1042313 | N/A | N/A | 452254 | 452273 | CCTCTTAGAGTCATTAACAA | 62 | 2718 |
| 1042345 | N/A | N/A | 452531 | 452550 | AGTAGGATCCAAAGGCATGA | 29 | 2719 |
| 1042377 | N/A | N/A | 453048 | 453067 | GTTCTGATACATTTCTAGAA | 37 | 2720 |
| 1042409 | N/A | N/A | 453856 | 453875 | GAACTCACAGTTTACATCTC | 53 | 2721 |
| 1042441 | N/A | N/A | 454688 | 454707 | TGTAGAATTAAAATATACAC | 95 | 2722 |
| 1042473 | N/A | N/A | 455314 | 455333 | TGAGTCCCTAAAACTGGATT | 112 | 2723 |
| 1042505 | N/A | N/A | 456275 | 456294 | TCCTTTCTAGATGTAGTAGA | 25 | 2724 |
| 1042537 | N/A | N/A | 456984 | 457003 | GTTTGCAAACCTCCCTCTCC | 101 | 2725 |

TABLE 37

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040106 | 2686 | 2705 | 437405 | 437424 | GGAGCCTTTCATGAAGTAGG | 28 | 2726 |
| 1040138 | 3195 | 3214 | 457448 | 457467 | TCTGGAAACTTCAGTTCGCC | 91 | 2727 |
| 1040170 | 3984 | 4003 | 458237 | 458256 | TTAACTTTCCAAATCTGCCA | 21 | 2728 |
| 1040202 | 4491 | 4510 | 458744 | 458763 | CTTCAAAATCTAATTCCTCA | 43 | 2729 |
| 1040234 | 4745 | 4764 | 458998 | 459017 | TACTAGTTCATAATTCACAT | 29 | 2730 |
| 1040266 | 5164 | 5183 | 459417 | 459436 | TCTCAGAGTTTCTAAGAGCC | 28 | 2731 |
| 1040298 | 5494 | 5513 | 459747 | 459766 | ATTTGTTCAGTTTAGTTGCA | 10 | 2732 |
| 1040330 | 5934 | 5953 | 460187 | 460206 | GAGAACAAAGTCTATGTGGC | 19 | 2733 |
| 1040362 | 6304 | 6323 | 460557 | 460576 | GGCTCCTTCCCTCCAGCCCT | 115 | 2734 |
| 1040394 | 7078 | 7097 | 461331 | 461350 | TTGGTTTCTTATTAATAGTA | 11 | 2735 |

TABLE 37-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040426 | 7579 | 7598 | 461832 | 461851 | TTGTACAACCCTACTCCAGA | 78 | 2736 |
| 1040458 | 7985 | 8004 | 462238 | 462257 | GGTTCATGAAACAGTAGCCA | 93 | 2737 |
| 1040490 | 8319 | 8338 | 462572 | 462591 | TATGCCAGAAACACAACACT | 86 | 2738 |
| 1040522 | 8669 | 8688 | 462922 | 462941 | ACATGTAACTTTCAACCCTT | 29 | 2739 |
| 1040554 | 9051 | 9070 | 463304 | 463323 | TTTTTGTCCCCATAATGAGT | 34 | 2740 |
| 1040586 | 9396 | 9415 | 463649 | 463668 | GGGACATGAAAAACTGAAGC | 22 | 2741 |
| 1040618 | 9830 | 9849 | 464083 | 464102 | AGGATTTACCCCACTCCTGG | 82 | 2742 |
| 1040650 | 10228 | 10247 | 464481 | 464500 | ATTTTCTTTTCAATAAGGTG | 17 | 2743 |
| 1040682 | 10481 | 10500 | 464734 | 464753 | TCTACCTAGAAAACCTGCAA | 44 | 2744 |
| 1040714 | N/A | N/A | 14865 | 14884 | CTCACATTTTAAAGAGTCTG | 41 | 2745 |
| 1040746 | N/A | N/A | 29049 | 29068 | TCACTGAACCCTTATTTTTT | 30 | 2746 |
| 1040778 | N/A | N/A | 46649 | 46668 | ACTAGAAAAGCCACCCTTCT | 129 | 2747 |
| 1040810 | N/A | N/A | 76238 | 76257 | AGTCTGTATATTTATATTTA | 47 | 2748 |
| 1040842 | N/A | N/A | 92036 | 92055 | CCTTTGTTTTAAAATAGGTA | 122 | 2749 |
| 1040874 | N/A | N/A | 114410 | 114429 | AATGCCAAAGATATACGCCA | 6 | 2750 |
| 1040906 | N/A | N/A | 145082 | 145101 | AGTTAATATCCTTAATACAA | 44 | 2751 |
| 1040938 | N/A | N/A | 173470 | 173489 | AAGTACTATCATTATTGCAT | 113 | 2752 |
| 1040970 | N/A | N/A | 193239 | 193258 | TTCCCCTTATTTTATTCATA | 63 | 2753 |
| 1041002 | N/A | N/A | 210713 | 210732 | TTCCTTCTAGATTAAAGACT | 62 | 2754 |
| 1041034 | N/A | N/A | 234265 | 234284 | AACACAATTTAAATTGAGTT | 127 | 2755 |
| 1041066 | N/A | N/A | 256364 | 256383 | CCTAAGTACCCTTAATTTTT | 65 | 2756 |
| 1041098 | N/A | N/A | 273876 | 273895 | TGTCTATTTCAAAGAAGCGA | 80 | 2757 |
| 1041130 | N/A | N/A | 292765 | 292784 | CACACAATTCAAAACTTGAA | 93 | 2758 |
| 1041162 | N/A | N/A | 322761 | 322780 | AGCAGAATCTAAATCGAACA | 22 | 2759 |
| 1041194 | N/A | N/A | 343565 | 343584 | CGTGTTTTTATTTAACAATA | 2 | 2760 |
| 1041226 | N/A | N/A | 369541 | 369560 | ATTTCTTATATTTATGGGCT | 3 | 2761 |
| 1041258 | N/A | N/A | 391393 | 391412 | TATAGTAGTATTTATAGCTC | 28 | 2762 |
| 1041290 | N/A | N/A | 424357 | 424376 | ACCCCATTTCAAAGACAAGG | 59 | 2763 |
| 1041322 | N/A | N/A | 437796 | 437815 | TGGAGGTTAATTCATTACAC | 12 | 2764 |
| 1041354 | N/A | N/A | 438250 | 438269 | TTGGCCTTATCATACCTAAA | 34 | 2765 |
| 1041386 | N/A | N/A | 438574 | 438593 | GTGCCCAGCCCTTCCACCTG | 55 | 2766 |
| 1041418 | N/A | N/A | 439153 | 439172 | GACTTTACCCCAAGCCCAGC | 98 | 2767 |
| 1041450 | N/A | N/A | 439516 | 439535 | TGCCCAAAACAATTCAAACC | 94 | 2768 |
| 1041482 | N/A | N/A | 440163 | 440182 | AGTTCATTTTCTTTCTCCTA | 5 | 2769 |
| 1041514 | N/A | N/A | 440419 | 440438 | GTCTGGTTTCTGCAGAGGCT | 42 | 2770 |
| 1041546 | N/A | N/A | 441292 | 441311 | CCTTTGGAACCTCAATTAAG | 89 | 2771 |

TABLE 37-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
| --- | --- | --- | --- | --- | --- | --- | --- |
| 1041578 | N/A | N/A | 441621 | 441640 | TGTCACCACCATACTATATC | 26 | 2772 |
| 1041610 | N/A | N/A | 442258 | 442277 | CCCCTCAGTTTTATATGCCA | 45 | 2773 |
| 1041642 | N/A | N/A | 442717 | 442736 | GCGCCACAGACTTATGGCCT | 142 | 2774 |
| 1041674 | N/A | N/A | 443092 | 443111 | GGCAGGGTAAAAATGGCTTA | 52 | 2775 |
| 1041706 | N/A | N/A | 443499 | 443518 | GAGCACTTTACCAATACATT | 23 | 2776 |
| 1041738 | N/A | N/A | 443965 | 443984 | ACCAACTATCTATTTTTTGA | 51 | 2777 |
| 1041770 | N/A | N/A | 444351 | 444370 | TGTAACCAATCTATCACACC | 30 | 2778 |
| 1041802 | N/A | N/A | 445261 | 445280 | ACACAAATCCCACATTAAAA | 92 | 2779 |
| 1041834 | N/A | N/A | 445611 | 445630 | TGGGCATTCTTAACTTTGTC | 28 | 2780 |
| 1041866 | N/A | N/A | 445897 | 445916 | TTGTATATTTCAATCTTAGA | 26 | 2781 |
| 1041898 | N/A | N/A | 446071 | 446090 | TTCTGGGCTCATAATTATTT | 52 | 2782 |
| 1041930 | N/A | N/A | 446687 | 446706 | TAGAATAGCCTTTATAACTT | 33 | 2783 |
| 1041962 | N/A | N/A | 446929 | 446948 | TTCAGTTATTTTCTCTCCAC | 16 | 2784 |
| 1041994 | N/A | N/A | 447710 | 447729 | TCCTGCCAAAAAATCTTCTT | 118 | 2785 |
| 1042026 | N/A | N/A | 448513 | 448532 | ACTCCCTACACTGTAGCAAC | 97 | 2786 |
| 1042058 | N/A | N/A | 448749 | 448768 | AATGGTATCCCATTCTTCCG | 63 | 2787 |
| 1042090 | N/A | N/A | 449075 | 449094 | GGCCTCAAAATATTATTGAG | 107 | 2788 |
| 1042122 | N/A | N/A | 449649 | 449668 | TTAACTGATCATTAACCGTT | 49 | 2789 |
| 1042154 | N/A | N/A | 449930 | 449949 | AAGATTATTCAGATAATCTG | 178 | 2790 |
| 1042186 | N/A | N/A | 450550 | 450569 | GGCCTTAGAATTAAATGCTG | 145 | 2791 |
| 1042218 | N/A | N/A | 451194 | 451213 | CTCCTCGATACTAACCCCTT | 118 | 2792 |
| 1042250 | N/A | N/A | 451676 | 451695 | TCTCAAAACTCCAAAGACAC | 80 | 2793 |
| 1042282 | N/A | N/A | 451937 | 451956 | GTGAGCCACATTATACACAC | 69 | 2794 |
| 1042314 | N/A | N/A | 452263 | 452282 | TCTTGCAAACCTCTTAGAGT | 74 | 2795 |
| 1042346 | N/A | N/A | 452544 | 452563 | ATTGACTGAAATAAGTAGGA | 16 | 2796 |
| 1042378 | N/A | N/A | 453050 | 453069 | TAGTTCTGATACATTTCTAG | 47 | 2797 |
| 1042410 | N/A | N/A | 453883 | 453902 | CATATTATCTCCAAATAAGC | 124 | 2798 |
| 1042442 | N/A | N/A | 454701 | 454720 | GGTCTATGAGAATTGTAGAA | 32 | 2799 |
| 1042474 | N/A | N/A | 455315 | 455334 | CTGAGTCCCTAAAACTGGAT | 78 | 2800 |
| 1042506 | N/A | N/A | 456290 | 456309 | AGTCAATTTCCAATGTCCTT | 21 | 2801 |
| 1042538 | N/A | N/A | 456985 | 457004 | AGTTTGCAAACCTCCCTCTC | 117 | 2802 |

TABLE 38

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTCTATTTGCAC | 2 | 138 |
| 1040107 | 2687 | 2706 | 437406 | 437425 | TGGAGCCTTTCATGAAGTAG | 23 | 2803 |
| 1040139 | 3196 | 3215 | 457449 | 457468 | CTCTGGAAACTTCAGTTCGC | 87 | 2804 |
| 1040171 | 3985 | 4004 | 458238 | 458257 | GTTAACTTTCCAAATCTGCC | 23 | 2805 |
| 1040203 | 4493 | 4512 | 458746 | 458765 | ATCTTCAAAATCTAATTCCT | 45 | 2806 |
| 1040235 | 4746 | 4765 | 458999 | 459018 | ATACTAGTTCATAATTCACA | 35 | 2807 |
| 1040267 | 5172 | 5191 | 459425 | 459444 | AAGAAAATTCTCAGAGTTTC | 56 | 2808 |
| 1040299 | 5502 | 5521 | 459755 | 459774 | AGTCAGGTATTTGTTCAGTT | 5 | 2809 |
| 1040331 | 5952 | 5971 | 460205 | 460224 | GTAAATAGTGATATTAATGA | 53 | 2810 |
| 1040363 | 6365 | 6384 | 460618 | 460637 | GCTCCCCGCCCCAGCACTCA | 102 | 2811 |
| 1040395 | 7081 | 7100 | 461334 | 461353 | TTGTTGGTTTCTTATTAATA | 16 | 2812 |
| 1040427 | 7580 | 7599 | 461833 | 461852 | ATTGTACAACCCTACTCCAG | 70 | 2813 |
| 1040459 | 7987 | 8006 | 462240 | 462259 | GTGGTTCATGAAACAGTAGC | 88 | 2814 |
| 1040491 | 8321 | 8340 | 462574 | 462593 | CCTATGCCAGAAACACAACA | 72 | 2815 |
| 1040523 | 8683 | 8702 | 462936 | 462955 | CTATATACAAAAAAACATGT | 121 | 2816 |
| 1040555 | 9099 | 9118 | 463352 | 463371 | CCCCCATTTAAATGAGGTGT | 141 | 2817 |
| 1040587 | 9424 | 9443 | 463677 | 463696 | CAGTTGAACCATTTGTATGC | 22 | 2818 |
| 1040619 | 9842 | 9861 | 464095 | 464114 | TGCACTAACTAAAGGATTTA | 46 | 2819 |
| 1040651 | 10229 | 10248 | 464482 | 464501 | AATTTTCTTTTCAATAAGGT | 93 | 2820 |
| 1040683 | 10482 | 10501 | 464735 | 464754 | TTCTACCTAGAAAACCTGCA | 41 | 2821 |
| 1040715 | N/A | N/A | 16686 | 16705 | CTCGAAAACATATCCCCCA | 52 | 2822 |
| 1040747 | N/A | N/A | 29088 | 29107 | TGGTAATTTTAAAATATGGG | 15 | 2823 |
| 1040779 | N/A | N/A | 48578 | 48597 | GTGTTAATTCAAAAAATTTC | 119 | 2824 |
| 1040811 | N/A | N/A | 76251 | 76270 | TGCATACAAATTTAGTCTGT | 21 | 2825 |
| 1040843 | N/A | N/A | 93032 | 93051 | TCTAGATTACAAACCATCCT | 110 | 2826 |
| 1040875 | N/A | N/A | 114768 | 114787 | TTTCATTTTATTTAAGCCAA | 20 | 2827 |
| 1040907 | N/A | N/A | 146636 | 146655 | AAGATGTTTTAAAATCTGAC | 107 | 2828 |
| 1040939 | N/A | N/A | 174742 | 174761 | GTACTTGTTCCTTAACCAAG | 149 | 2829 |
| 1040971 | N/A | N/A | 193345 | 193364 | TCAGTTTACCTTTAATGGAA | 30 | 2830 |
| 1041003 | N/A | N/A | 211774 | 211793 | TGCTCAATATTTTAAACATT | 44 | 2831 |
| 1041035 | N/A | N/A | 234289 | 234308 | GTCGGATAAATTTATCCACA | 131 | 2832 |
| 1041067 | N/A | N/A | 256544 | 256563 | TTAGCAAACATTTATGAGCA | 45 | 2833 |
| 1041099 | N/A | N/A | 274538 | 274557 | CTTCCAATCCATTACATCTT | 81 | 2834 |
| 1041131 | N/A | N/A | 293124 | 293143 | CCTTCCAACCCTTAGCCTTT | 12 | 2835 |
| 1041163 | N/A | N/A | 323168 | 323187 | AGCCAAAAACCCATGGACCA | 120 | 2836 |
| 1041195 | N/A | N/A | 343967 | 343986 | ACAGTAATCTTTTATACAAG | 19 | 2837 |

TABLE 38-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041227 | N/A | N/A | 369669 | 369688 | TTCCCGAACCCTTAAGGATA | 99 | 2838 |
| 1041259 | N/A | N/A | 391405 | 391424 | AGTTGACACCTTTATAGTAG | 4 | 2839 |
| 1041291 | N/A | N/A | 424646 | 424665 | GTCTTAAAACTATTCACTGT | 81 | 2840 |
| 1041323 | N/A | N/A | 437820 | 437839 | ATAACTAGCCCCACTCTCCA | 98 | 2841 |
| 1041355 | N/A | N/A | 438251 | 438270 | GTTGGCCTTATCATACCTAA | 21 | 2842 |
| 1041387 | N/A | N/A | 438878 | 438897 | GCTGCCTTCCATCTGTTTTT | 90 | 2843 |
| 1041419 | N/A | N/A | 439154 | 439173 | TGACTTTACCCCAAGCCCAG | 109 | 2844 |
| 1041451 | N/A | N/A | 439554 | 439573 | GAGACAAGAAACACTGTCTC | 153 | 2845 |
| 1041483 | N/A | N/A | 440171 | 440190 | CTCAAGGTAGTTCATTTTCT | 10 | 2846 |
| 1041515 | N/A | N/A | 440723 | 440742 | GCCTACAATCCCAGCTTTAG | 88 | 2847 |
| 1041547 | N/A | N/A | 441337 | 441356 | GAGAAAACCCCTCAGGAAGG | 115 | 2848 |
| 1041579 | N/A | N/A | 441623 | 441642 | TCTGTCACCACCATACTATA | 57 | 2849 |
| 1041611 | N/A | N/A | 442265 | 442284 | CTAAACACCCCTCAGTTTTA | 100 | 2850 |
| 1041643 | N/A | N/A | 442722 | 442741 | TGGATGCGCCACAGACTTAT | 59 | 2851 |
| 1041675 | N/A | N/A | 443093 | 443112 | AGGCAGGGTAAAAATGGCTT | 66 | 2852 |
| 1041707 | N/A | N/A | 443502 | 443521 | CCAGAGCACTTTACCAATAC | 30 | 2853 |
| 1041739 | N/A | N/A | 443966 | 443985 | CACCAACTATCTATTTTTG | 47 | 2854 |
| 1041771 | N/A | N/A | 444355 | 444374 | CAGTTGTAACCAATCTATCA | 22 | 2855 |
| 1041803 | N/A | N/A | 445267 | 445286 | CTCCTAACACAAATCCCACA | 124 | 2856 |
| 1041835 | N/A | N/A | 445625 | 445644 | CGAAATTATTAAATTGGGCA | 36 | 2857 |
| 1041867 | N/A | N/A | 445899 | 445918 | GATTGTATATTTCAATCTTA | 55 | 2858 |
| 1041899 | N/A | N/A | 446086 | 446105 | ACAACACCGACTCACTTCTG | 41 | 2859 |
| 1041931 | N/A | N/A | 446708 | 446727 | TCAAACACCCTAAGCAGTAA | 74 | 2860 |
| 1041963 | N/A | N/A | 446930 | 446949 | CTTCAGTTATTTTCTCTCCA | 10 | 2861 |
| 1041995 | N/A | N/A | 447711 | 447730 | ATCCTGCCAAAAAATCTTCT | 100 | 2862 |
| 1042027 | N/A | N/A | 448517 | 448536 | CCTTACTCCCTACACTGTAG | 99 | 2863 |
| 1042059 | N/A | N/A | 448770 | 448789 | ATGTTCTTCCCCATCTCCAT | 36 | 2864 |
| 1042091 | N/A | N/A | 449076 | 449095 | CGGCCTCAAAATATTATTGA | 165 | 2865 |
| 1042123 | N/A | N/A | 449669 | 449688 | GATATAAACATTCTTAAAGG | 92 | 2866 |
| 1042155 | N/A | N/A | 449932 | 449951 | GGAAGATTATTCAGATAATC | 24 | 2867 |
| 1042187 | N/A | N/A | 450551 | 450570 | AGGCCTTAGAATTAAATGCT | 137 | 2868 |
| 1042219 | N/A | N/A | 451198 | 451217 | CAGTCTCCTCGATACTAACC | 67 | 2869 |
| 1042251 | N/A | N/A | 451677 | 451696 | ATCTCAAAACTCCAAAGACA | 87 | 2870 |
| 1042283 | N/A | N/A | 451938 | 451957 | TGTGAGCCACATTATACACA | 69 | 2871 |
| 1042315 | N/A | N/A | 452264 | 452283 | CTCTTGCAAACCTCTTAGAG | 99 | 2872 |
| 1042347 | N/A | N/A | 452571 | 452590 | TCCTGCTACCCCCAACAGT | 124 | 2873 |

TABLE 38-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042379 | N/A | N/A | 453088 | 453107 | TTCATCTTCTTTGTTTCCTT | 25 | 2874 |
| 1042411 | N/A | N/A | 453892 | 453911 | AACAAAATACATATTATCTC | 99 | 2875 |
| 1042443 | N/A | N/A | 454927 | 454946 | CCGTTTCTACAGAAATTTAA | 78 | 2876 |
| 1042475 | N/A | N/A | 455316 | 455335 | TCTGAGTCCCTAAAACTGGA | 90 | 2877 |
| 1042507 | N/A | N/A | 456620 | 456639 | CCCAGCCCCTAAAAGGATGC | 118 | 2878 |
| 1042539 | N/A | N/A | 457035 | 457054 | AGGTATGAACTCACACAGAC | 63 | 2879 |

TABLE 39

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040108 | 2725 | 2744 | 437444 | 437463 | TTCCACCTTCTTTAGCTCCC | 67 | 2880 |
| 1040140 | 3212 | 3231 | 457465 | 457484 | CAGGCAATCCCATTTTCTCT | 84 | 2881 |
| 1040172 | 4000 | 4019 | 458253 | 458272 | ATGTTCTTTTAAATGGTTAA | 15 | 2882 |
| 1040204 | 4494 | 4513 | 458747 | 458766 | CATCTTCAAAATCTAATTCC | 66 | 2883 |
| 1040236 | 4749 | 4768 | 459002 | 459021 | CACATACTAGTTCATAATTC | 20 | 2884 |
| 1040268 | 5188 | 5207 | 459441 | 459460 | TCTCTCAATGAATCTGAAGA | 26 | 2885 |
| 1040300 | 5514 | 5533 | 459767 | 459786 | GGGTAAAAGAAAAGTCAGGT | 10 | 2886 |
| 1040332 | 5954 | 5973 | 460207 | 460226 | TTGTAAATAGTGATATTAAT | 74 | 2887 |
| 1040364 | 6439 | 6458 | 460692 | 460711 | CTGCGGTTCCTCCCCCGGGT | 124 | 2888 |
| 1040396 | 7117 | 7136 | 461370 | 461389 | ATATATTTAGAAATCCCTAG | 82 | 2889 |
| 1040428 | 7581 | 7600 | 461834 | 461853 | AATTGTACAACCCTACTCCA | 98 | 2890 |
| 1040460 | 8014 | 8033 | 462267 | 462286 | GCAACAGACCAGTCTGTTGA | 113 | 2891 |
| 1040492 | 8323 | 8342 | 462576 | 462595 | TCCCTATGCCAGAAACACAA | 70 | 2892 |
| 1040524 | 8684 | 8703 | 462937 | 462956 | TCTATATACAAAAAACATG | 103 | 2893 |
| 1040556 | 9100 | 9119 | 463353 | 463372 | CCCCCCATTTAAATGAGGTG | 114 | 2894 |
| 1040588 | 9426 | 9445 | 463679 | 463698 | TACAGTTGAACCATTTGTAT | 67 | 2895 |
| 1040620 | 9862 | 9881 | 464115 | 464134 | GCACAGGTATCAAGTTCAAA | 17 | 2896 |
| 1040652 | 10235 | 10254 | 464488 | 464507 | ACTTAAAATTTCTTTTCAA | 109 | 2897 |
| 1040684 | 10493 | 10512 | 464746 | 464765 | AATGAAATAATTTCTACCTA | 55 | 2898 |
| 1040716 | N/A | N/A | 16822 | 16841 | GGCACATTTTAAAAGAAGC | 23 | 2899 |
| 1040748 | N/A | N/A | 30745 | 30764 | TGTTTGCTATTTTAAGAGCC | 24 | 2900 |
| 1040780 | N/A | N/A | 48620 | 48639 | GCTAGTAAAATTTAGGGCAG | 36 | 2901 |
| 1040812 | N/A | N/A | 76786 | 76805 | TCTGAAAACCTCTTCCTCT | 60 | 2902 |

TABLE 39-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040844 | N/A | N/A | 93297 | 93316 | GATGCATTTCATTACTGCTT | 41 | 2903 |
| 1040876 | N/A | N/A | 114844 | 114863 | ATGTAATATTAAATAGCATC | 70 | 2904 |
| 1040908 | N/A | N/A | 148861 149972 | 148880 149991 | AGGTAATTTCAAAGCTTCCA | 4 | 2905 |
| 1040940 | N/A | N/A | 175616 | 175635 | CTTTCAATTCCTTAAAAGGA | 101 | 2906 |
| 1040972 | N/A | N/A | 195063 | 195082 | ACACACAAAGAATGAACCAT | 57 | 2907 |
| 1041004 | N/A | N/A | 212966 | 212985 | ATCCTAATTCAAAAACTAGT | 131 | 2908 |
| 1041036 | N/A | N/A | 235568 | 235587 | AGCCATAAAACCATGCGGTT | 91 | 2909 |
| 1041068 | N/A | N/A | 256941 | 256960 | TTACCCAAATTATCACTGTA | 47 | 2910 |
| 1041100 | N/A | N/A | 274711 | 274730 | GGACTTAACCCTTACTCCAA | 84 | 2911 |
| 1041132 | N/A | N/A | 293412 | 293431 | TGTTAGCTATTTTATATGGA | 2 | 2912 |
| 1041164 | N/A | N/A | 323174 | 323193 | TTACACAGCCAAAAACCCAT | 100 | 2913 |
| 1041196 | N/A | N/A | 344505 | 344524 | TGAGTAATTTAAAATGCCCA | 43 | 2914 |
| 1041228 | N/A | N/A | 369876 | 369895 | AAGGTCTGCCTTTAACATTT | 14 | 2915 |
| 1041260 | N/A | N/A | 392003 | 392022 | GTAAAATTTCTTTATGTGTG | 4 | 2916 |
| 1041292 | N/A | N/A | 424647 | 424666 | AGTCTTAAAACTATTCACTG | 78 | 2917 |
| 1041324 | N/A | N/A | 437831 | 437850 | TCAAGGACTCCATAACTAGC | 111 | 2918 |
| 1041356 | N/A | N/A | 438263 | 438282 | GCTGATCTATCTGTTGGCCT | 58 | 2919 |
| 1041388 | N/A | N/A | 438882 | 438901 | TAGGGCTGCCTTCCATCTGT | 51 | 2920 |
| 1041420 | N/A | N/A | 439156 | 439175 | GCTGACTTTACCCCAAGCCC | 100 | 2921 |
| 1041452 | N/A | N/A | 439834 | 439853 | AATGCTCAAAAAGCCAGAC | 54 | 2922 |
| 1041484 | N/A | N/A | 440190 | 440209 | CTGTGAAGAGTCAACTTTGC | 65 | 2923 |
| 1041516 | N/A | N/A | 440724 | 440743 | CGCCTACAATCCCAGCTTTA | 93 | 2924 |
| 1041548 | N/A | N/A | 441358 | 441377 | GGAAGATTCTTCAGGCTAGG | 11 | 2925 |
| 1041580 | N/A | N/A | 441624 | 441643 | GTCTGTCACCACCATACTAT | 34 | 2926 |
| 1041612 | N/A | N/A | 442271 | 442290 | CCCAAACTAAACACCCCTCA | 97 | 2927 |
| 1041644 | N/A | N/A | 442787 | 442806 | AGCCCATCCTTCTTTTGAG | 88 | 2928 |
| 1041676 | N/A | N/A | 443103 | 443122 | CGAGGATTACAGGCAGGGTA | 15 | 2929 |
| 1041708 | N/A | N/A | 443511 | 443530 | CGTGTCAACCCAGAGCACTT | 120 | 2930 |
| 1041740 | N/A | N/A | 443969 | 443988 | AGTCACCAACTATCTATTTT | 53 | 2931 |
| 1041772 | N/A | N/A | 444356 | 444375 | TCAGTTGTAACCAATCTATC | 20 | 2932 |
| 1041804 | N/A | N/A | 445269 | 445288 | GCCTCCTAACACAAATCCCA | 93 | 2933 |
| 1041836 | N/A | N/A | 445626 | 445645 | GCGAAATTATTAAATTGGGC | 50 | 2934 |
| 1041868 | N/A | N/A | 445900 | 445919 | TGATTGTATATTTCAATCTT | 114 | 2935 |
| 1041900 | N/A | N/A | 446090 | 446109 | GGAGACAACACCGACTCACT | 81 | 2936 |
| 1041932 | N/A | N/A | 446710 | 446729 | TTTCAAACACCCTAAGCAGT | 92 | 2937 |

TABLE 39-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041964 | N/A | N/A | 446938 | 446957 | GAATCACACTTCAGTTATTT | 19 | 2938 |
| 1041996 | N/A | N/A | 447713 | 447732 | CCATCCTGCCAAAAAATCTT | 111 | 2939 |
| 1042028 | N/A | N/A | 448519 | 448538 | CCCCTTACTCCCTACACTGT | 95 | 2940 |
| 1042060 | N/A | N/A | 448773 | 448792 | CCCATGTTCTTCCCCATCTC | 70 | 2941 |
| 1042092 | N/A | N/A | 449077 | 449096 | CCGGCCTCAAAATATTATTG | 114 | 2942 |
| 1042124 | N/A | N/A | 449672 | 449691 | AAGGATATAAACATTCTTAA | 73 | 2943 |
| 1042156 | N/A | N/A | 449935 | 449954 | AGCGGAAGATTATTCAGATA | 18 | 2944 |
| 1042188 | N/A | N/A | 450567 | 450586 | CCAAATCTCCAAAGACAGGC | 54 | 2945 |
| 1042220 | N/A | N/A | 451224 | 451243 | ACTGGTGCCCAAATGTCTAT | 54 | 2946 |
| 1042252 | N/A | N/A | 451679 | 451698 | GCATCTCAAAACTCCAAAGA | 31 | 2947 |
| 1042284 | N/A | N/A | 451940 | 451959 | TGTGTGAGCCACATTATACA | 86 | 2948 |
| 1042316 | N/A | N/A | 452275 | 452294 | CTCCATAGATCCTCTTGCAA | 106 | 2949 |
| 1042348 | N/A | N/A | 452589 | 452608 | AAGAGATGAACTAAGCATTC | 52 | 2950 |
| 1042380 | N/A | N/A | 453101 | 453120 | GTTGCTTTTCTACTTCATCT | 21 | 2951 |
| 1042412 | N/A | N/A | 453897 | 453916 | TCTAGAACAAAATACATATT | 131 | 2952 |
| 1042444 | N/A | N/A | 455045 | 455064 | ATCCATGAAGCCAGGCATGG | 165 | 2953 |
| 1042476 | N/A | N/A | 455318 | 455337 | CATCTGAGTCCCTAAAACTG | 93 | 2954 |
| 1042508 | N/A | N/A | 456623 | 456642 | GTCCCCAGCCCCTAAAGGA | 101 | 2955 |
| 1042540 | N/A | N/A | 457036 | 457055 | CAGGTATGAACTCACACAGA | 56 | 2956 |

TABLE 40

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 3 | 138 |
| 1040109 | 2741 | 2760 | 437460 | 437479 | CTTCTGTTTTAAGTCTTCC | 30 | 2957 |
| 1040141 | 3213 | 3232 | 457466 | 457485 | GCAGGCAATCCCATTTTCTC | 78 | 2958 |
| 1040173 | 4010 | 4029 | 458263 | 458282 | GGAGAGAAAAATGTTCTTTT | 5 | 2959 |
| 1040205 | 4497 | 4516 | 458750 | 458769 | GCTCATCTTCAAAATCTAAT | 9 | 2960 |
| 1040237 | 4758 | 4777 | 459011 | 459030 | ATTTATTGTCACATACTAGT | 76 | 2961 |
| 1040269 | 5216 | 5235 | 459469 | 459488 | CACATATATAAATGTCTTTA | 28 | 2962 |
| 1040301 | 5533 | 5552 | 459786 | 459805 | GAAAGTACTATTTTCAATGG | 27 | 2963 |
| 1040333 | 5959 | 5978 | 460212 | 460231 | ATGAGTTGTAAATAGTGATA | 22 | 2964 |
| 1040365 | 6440 | 6459 | 460693 | 460712 | ACTGCGGTTCCTCCCCCGGG | 111 | 2965 |
| 1040397 | 7126 | 7145 | 461379 | 461398 | AGTCATTTTATATATTTAGA | 58 | 2966 |

TABLE 40-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1040429 | 7601 | 7620 | 461854 | 461873 | GAAATCCAAACATTCCTTGA | 51 | 2967 |
| 1040461 | 8061 | 8080 | 462314 | 462333 | GCCCTGTTTTCACCTGGTGC | 57 | 2968 |
| 1040493 | 8325 | 8344 | 462578 | 462597 | TTTCCCTATGCCAGAAACAC | 63 | 2969 |
| 1040525 | 8685 | 8704 | 462938 | 462957 | TTCTATATACAAAAAACAT | 107 | 2970 |
| 1040557 | 9101 | 9120 | 463354 | 463373 | TCCCCCCATTTAAATGAGGT | 145 | 2971 |
| 1040589 | 9439 | 9458 | 463692 | 463711 | CACTTAATTTTAATACAGTT | 44 | 2972 |
| 1040621 | 9883 | 9902 | 464136 | 464155 | GCAGTATTCACAGAACTGAA | 61 | 2973 |
| 1040653 | 10237 | 10256 | 464490 | 464509 | GCACTTAAAATTTTCTTTTC | 17 | 2974 |
| 1040685 | 10507 | 10526 | 464760 | 464779 | TGTTTTATTATAATAATGAA | 157 | 2975 |
| 1040717 | N/A | N/A | 17529 | 17548 | ACATCAAAACGATTTCTACT | 25 | 2976 |
| 1040749 | N/A | N/A | 31007 | 31026 | AACCAAAACCAAAAGCCTCT | 51 | 2977 |
| 1040781 | N/A | N/A | 48839 | 48858 | AATCTAAAATACATCTGCAT | 103 | 2978 |
| 1040813 | N/A | N/A | 77220 | 77239 | CAGTTTATTTAAAGATATAA | 119 | 2979 |
| 1040845 | N/A | N/A | 94390 | 94409 | ATCAGTAAAGAATTGATGTC | 115 | 2980 |
| 1040877 | N/A | N/A | 114917 | 114936 | CTTCATAAAATTCCATTCTG | 26 | 2981 |
| 1040909 | N/A | N/A | 148914 150025 | 148933 150044 | GCTTTCATAATATAACAACC | 6 | 2982 |
| 1040941 | N/A | N/A | 176494 | 176513 | ATCAACAAAATTATGTATGG | 124 | 2983 |
| 1040973 | N/A | N/A | 195332 | 195351 | GGAAACAACCAAAGTTTTTT | 58 | 2984 |
| 1041005 | N/A | N/A | 213451 | 213470 | CTGTAGTTTTAAAAGTGCCT | 15 | 2985 |
| 1041037 | N/A | N/A | 236934 | 236953 | ACCATATTTCTTTAGAAGGT | 70 | 2986 |
| 1041069 | N/A | N/A | 257007 | 257026 | GTGACCAAAATACATATACT | 47 | 2987 |
| 1041101 | N/A | N/A | 274862 | 274881 | ACTGGATTTATTTAAGTCTT | 96 | 2988 |
| 1041133 | N/A | N/A | 294752 | 294771 | GAGTCTTGCCCTTAAGAAGC | 4 | 2989 |
| 1041165 | N/A | N/A | 323691 | 323710 | TTGATATTTCAAAAGAGCTA | 45 | 2990 |
| 1041197 | N/A | N/A | 344706 | 344725 | ATGTAAATATTTTAGCACAG | 3 | 2991 |
| 1041229 | N/A | N/A | 370271 | 370290 | GACTAATTTTAAAATATGCT | 36 | 2992 |
| 1041261 | N/A | N/A | 392692 | 392711 | GAGATAAAATTATGTAGTT | 86 | 2993 |
| 1041293 | N/A | N/A | 425116 | 425135 | TGGGATAATATTTATAAGTG | 43 | 2994 |
| 1041325 | N/A | N/A | 437884 | 437903 | ATCTTAATCACAGAATTCAA | 46 | 2995 |
| 1041357 | N/A | N/A | 438268 | 438287 | TGTCTGCTGATCTATCTGTT | 14 | 2996 |
| 1041389 | N/A | N/A | 438883 | 438902 | TTAGGGCTGCCTTCCATCTG | 58 | 2997 |
| 1041421 | N/A | N/A | 439158 | 439177 | CAGCTGACTTTACCCCAAGC | 77 | 2998 |
| 1041453 | N/A | N/A | 439844 | 439863 | GCATTTAAGAAATGCTCAAA | 132 | 2999 |
| 1041485 | N/A | N/A | 440217 | 440236 | GTTTATTTTCCATGTGTCAC | 2 | 3000 |
| 1041517 | N/A | N/A | 440772 | 440791 | CTCCCCAAGAACAGAAGAGG | 149 | 3001 |

TABLE 40-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041549 | N/A | N/A | 441359 | 441378 | AGGAAGATTCTTCAGGCTAG | 17 | 3002 |
| 1041581 | N/A | N/A | 441646 | 441665 | AGACCCAAATCCGCACCCCT | 134 | 3003 |
| 1041613 | N/A | N/A | 442273 | 442292 | TCCCCAAACTAAACACCCCT | 106 | 3004 |
| 1041645 | N/A | N/A | 442814 | 442833 | TACTTCCTACCCAAGGAGGA | 124 | 3005 |
| 1041677 | N/A | N/A | 443114 | 443133 | GGATTCCACCCCGAGGATTA | 120 | 3006 |
| 1041709 | N/A | N/A | 443555 | 443574 | CCCTAATAACACAGAGCCTG | 113 | 3007 |
| 1041741 | N/A | N/A | 443971 | 443990 | GCAGTCACCAACTATCTATT | 47 | 3008 |
| 1041773 | N/A | N/A | 444357 | 444376 | ATCAGTTGTAACCAATCTAT | 16 | 3009 |
| 1041805 | N/A | N/A | 445298 | 445317 | TCAGTAAACCCACACCCTAG | 109 | 3010 |
| 1041837 | N/A | N/A | 445627 | 445646 | GGCGAAATTATTAAATTGGG | 100 | 3011 |
| 1041869 | N/A | N/A | 445902 | 445921 | TTTGATTGTATATTTCAATC | 85 | 3012 |
| 1041901 | N/A | N/A | 446109 | 446128 | GATGGACGAACCTAGACAGG | 54 | 3013 |
| 1041933 | N/A | N/A | 446716 | 446735 | ATCCTGTTTCAAACACCCTA | 27 | 3014 |
| 1041965 | N/A | N/A | 446945 | 446964 | TTTTATTGAATCACACTTCA | 41 | 3015 |
| 1041997 | N/A | N/A | 447722 | 447741 | TCCCTCTTCCCATCCTGCCA | 89 | 3016 |
| 1042029 | N/A | N/A | 448526 | 448545 | GCATGTGCCCCTTACTCCCT | 84 | 3017 |
| 1042061 | N/A | N/A | 448774 | 448793 | TCCCATGTTCTTCCCCATCT | 72 | 3018 |
| 1042093 | N/A | N/A | 449386 | 449405 | AGCTTCAAAATATTGTTATT | 53 | 3019 |
| 1042125 | N/A | N/A | 449674 | 449693 | ATAAGGATATAAACATTCTT | 59 | 3020 |
| 1042157 | N/A | N/A | 449937 | 449956 | GGAGCGGAAGATTATTCAGA | 33 | 3021 |
| 1042189 | N/A | N/A | 450569 | 450588 | CTCCAAATCTCCAAAGACAG | 86 | 3022 |
| 1042221 | N/A | N/A | 451237 | 451256 | TTCTTGAACCCTCACTGGTG | 100 | 3023 |
| 1042253 | N/A | N/A | 451681 | 451700 | CCGCATCTCAAAACTCCAAA | 9 | 3024 |
| 1042285 | N/A | N/A | 451942 | 451961 | GGTGTGTGAGCCACATTATA | 47 | 3025 |
| 1042317 | N/A | N/A | 452277 | 452296 | GGCTCCATAGATCCTCTTGC | 95 | 3026 |
| 1042349 | N/A | N/A | 452631 | 452650 | TGACCTCTACCCTTGTGAGC | 47 | 3027 |
| 1042381 | N/A | N/A | 453102 | 453121 | TGTTGCTTTTCTACTTCATC | 73 | 3028 |
| 1042413 | N/A | N/A | 453898 | 453917 | CTCTAGAACAAAATACATAT | 88 | 3029 |
| 1042445 | N/A | N/A | 455059 | 455078 | TCTGTTTTTAAAAGATCCAT | 36 | 3030 |
| 1042477 | N/A | N/A | 455353 | 455372 | AACAGGCCTTTCAAGGTCTG | 123 | 3031 |
| 1042509 | N/A | N/A | 456640 | 456659 | AGTGTGTTTATCACTGAGTC | 97 | 3032 |
| 1042541 | N/A | N/A | 457060 | 457079 | CTTGTTTGATTTATGCACA | 92 | 3033 |

TABLE 41

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 1040110 | 2743 | 2762 | 437462 | 437481 | ATCTTCTGTTTTTAAGTCTT | 41 | 3034 |
| 1040142 | 3214 | 3233 | 457467 | 457486 | TGCAGGCAATCCCATTTTCT | 99 | 3035 |
| 1040174 | 4012 | 4031 | 458265 | 458284 | TTGGAGAGAAAAATGTTCTT | 23 | 3036 |
| 1040206 | 4499 | 4518 | 458752 | 458771 | ATGCTCATCTTCAAAATCTA | 23 | 3037 |
| 1040238 | 4763 | 4782 | 459016 | 459035 | TGGTCATTTATTGTCACATA | 6 | 3038 |
| 1040270 | 5220 | 5239 | 459473 | 459492 | TGCTCACATATATAAATGTC | 36 | 3039 |
| 1040302 | 5570 | 5589 | 459823 | 459842 | GTTGATACCAGATTTTTTTT | 30 | 3040 |
| 1040334 | 6015 | 6034 | 460268 | 460287 | AGTCAATTCAATACTCGAAG | 6 | 3041 |
| 1040366 | 6474 | 6493 | 460727 | 460746 | TCCACATTCACTATTCCGTG | 17 | 3042 |
| 1040398 | 7128 | 7147 | 461381 | 461400 | ACAGTCATTTTATATATTTA | 34 | 3043 |
| 1040430 | 7604 | 7623 | 461857 | 461876 | CAGGAAATCCAAACATTCCT | 130 | 3044 |
| 1040462 | 8106 | 8125 | 462359 | 462378 | TCACATCACCACCGAAGAAA | 40 | 3045 |
| 1040494 | 8331 | 8350 | 462584 | 462603 | TTGGAGTTTCCCTATGCCAG | 17 | 3046 |
| 1040526 | 8692 | 8711 | 462945 | 462964 | GACAAATTTCTATATACAAA | 57 | 3047 |
| 1040558 | 9103 | 9122 | 463356 | 463375 | ACTCCCCCCATTTAAATGAG | 116 | 3048 |
| 1040590 | 9440 | 9459 | 463693 | 463712 | GCACTTAATTTTAATACAGT | 15 | 3049 |
| 1040622 | 9884 | 9903 | 464137 | 464156 | GGCAGTATTCACAGAACTGA | 41 | 3050 |
| 1040654 | 10253 | 10272 | 464506 | 464525 | CTTAACTATTATGTATGCAC | 17 | 3051 |
| 1040686 | 10508 | 10527 | 464761 | 464780 | TTGTTTTATTATAATAATGA | 195 | 3052 |
| 1040718 | N/A | N/A | 17546 | 17565 | GCAGGTAAAACCAAATGACA | 121 | 3053 |
| 1040750 | N/A | N/A | 31009 | 31028 | GCAACCAAAACCAAAAGCCT | 67 | 3054 |
| 1040782 | N/A | N/A | 49205 | 49224 | GGGCTATTAATTTATTAAAT | 123 | 3055 |
| 1040814 | N/A | N/A | 77279 | 77298 | AAGATCTTTTAAAGTCCTAC | 58 | 3056 |
| 1040846 | N/A | N/A | 94692 | 94711 | GTAAGCTCCATTTATAGAAT | 30 | 3057 |
| 1040878 | N/A | N/A | 117437 | 117456 | CCTCACACACCTTAACCCTG | 95 | 3058 |
| 1040910 | N/A | N/A | 151015 | 151034 | GAGATAAAAATTATTTTGGC | 108 | 3059 |
| 1040942 | N/A | N/A | 176706 | 176725 | GCTAAATTTCATTAGAAACA | 115 | 3060 |
| 1040974 | N/A | N/A | 195854 | 195873 | TTTTCTACAATTTATAGGCG | 27 | 3061 |
| 1041006 | N/A | N/A | 215585 | 215604 | CTGCACCAAATTTATTTTTG | 37 | 3062 |
| 1041038 | N/A | N/A | 237026 | 237045 | ACTGAAAAAACTGTATGATC | 99 | 3063 |
| 1041070 | N/A | N/A | 257572 | 257591 | CCTTTTAAAATTTCCAGAAA | 97 | 3064 |
| 1041102 | N/A | N/A | 276104 | 276123 | GAAGTTAGCCAGGCATCAGG | 77 | 3065 |
| 1041134 | N/A | N/A | 294914 | 294933 | GCAGAGTTTTAAAATGCACT | 14 | 3066 |
| 1041166 | N/A | N/A | 324245 | 324264 | AGGCATAGTATTTAGCAGAA | 2 | 3067 |
| 1041198 | N/A | N/A | 345616 | 345635 | TACTTCTTTCCTTAAGCACA | 6 | 3068 |

TABLE 41-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1041230 | N/A | N/A | 370434 | 370453 | TAGTTTAAAATATGTGACTC | 96 | 3069 |
| 1041262 | N/A | N/A | 393162 | 393181 | CCAGAAAAACCTTAAACTAC | 73 | 3070 |
| 1041294 | N/A | N/A | 425225 | 425244 | ACCTTCAAACTATCAATTCT | 105 | 3071 |
| 1041326 | N/A | N/A | 437890 | 437909 | TTCCTCATCTTAATCACAGA | 25 | 3072 |
| 1041358 | N/A | N/A | 438300 | 438319 | GAGAGTATAAAAATTATCTC | 102 | 3073 |
| 1041390 | N/A | N/A | 438894 | 438913 | GTCCATCACACTTAGGGCTG | 37 | 3074 |
| 1041422 | N/A | N/A | 439161 | 439180 | CTACAGCTGACTTTACCCCA | 50 | 3075 |
| 1041454 | N/A | N/A | 439848 | 439867 | TTGGGCATTTAAGAAATGCT | 116 | 3076 |
| 1041486 | N/A | N/A | 440219 | 440238 | ATGTTTATTTTCCATGTGTC | 3 | 3077 |
| 1041518 | N/A | N/A | 440776 | 440795 | CTTCCTCCCCAAGAACAGAA | 88 | 3078 |
| 1041550 | N/A | N/A | 441384 | 441403 | CAGTGCCTAACCAGTTGAGA | 28 | 3079 |
| 1041582 | N/A | N/A | 441650 | 441669 | CCAGAGACCCAAATCCGCAC | 65 | 3080 |
| 1041614 | N/A | N/A | 442275 | 442294 | CATCCCCAAACTAAACACCC | 95 | 3081 |
| 1041646 | N/A | N/A | 442820 | 442839 | CTAACCTACTTCCTACCCAA | 133 | 3082 |
| 1041678 | N/A | N/A | 443164 | 443183 | AGCCTTAGAAACAGGAACGG | 46 | 3083 |
| 1041710 | N/A | N/A | 443556 | 443575 | GCCCTAATAACACAGAGCCT | 142 | 3084 |
| 1041742 | N/A | N/A | 444005 | 444024 | CGGCACAAATCCAGGGCTGG | 87 | 3085 |
| 1041774 | N/A | N/A | 444387 | 444406 | TAGTTAAAAATAAGGTATCG | 87 | 3086 |
| 1041806 | N/A | N/A | 445299 | 445318 | TTCAGTAAACCCACACCCTA | 110 | 3087 |
| 1041838 | N/A | N/A | 445628 | 445647 | TGGCGAAATTATTAAATTGG | 102 | 3088 |
| 1041870 | N/A | N/A | 445919 | 445938 | CACGCATATTTATGCTGTTT | 86 | 3089 |
| 1041902 | N/A | N/A | 446110 | 446129 | GGATGGACGAACCTAGACAG | 34 | 3090 |
| 1041934 | N/A | N/A | 446718 | 446737 | ATATCCTGTTTCAAACACCC | 43 | 3091 |
| 1041966 | N/A | N/A | 446947 | 446966 | GATTTTATTGAATCACACTT | 19 | 3092 |
| 1041998 | N/A | N/A | 447903 | 447922 | CAACCATTCCAGACTGAGCT | 109 | 3093 |
| 1042030 | N/A | N/A | 448548 | 448567 | ACATGCAAGCCTGATGTGGT | 121 | 3094 |
| 1042062 | N/A | N/A | 448818 | 448837 | CTAAAACACACCAGACCTCC | 91 | 3095 |
| 1042094 | N/A | N/A | 449387 | 449406 | TAGCTTCAAAATATTGTTAT | 62 | 3096 |
| 1042126 | N/A | N/A | 449684 | 449703 | TAGGTTTGTCATAAGGATAT | 11 | 3097 |
| 1042158 | N/A | N/A | 449978 | 449997 | GCCACGACCAGATATCAGCT | 39 | 3098 |
| 1042190 | N/A | N/A | 450570 | 450589 | ACTCCAAATCTCCAAAGACA | 95 | 3099 |
| 1042222 | N/A | N/A | 451238 | 451257 | CTTCTTGAACCCTCACTGGT | 119 | 3100 |
| 1042254 | N/A | N/A | 451682 | 451701 | TCCGCATCTCAAAACTCCAA | 28 | 3101 |
| 1042286 | N/A | N/A | 451968 | 451987 | GGACACCTACCCATGGAGAG | 57 | 3102 |
| 1042318 | N/A | N/A | 452311 | 452330 | ACTGTATTCTAAGTAGGAGG | 23 | 3103 |
| 1042350 | N/A | N/A | 452636 | 452655 | CCTCCTGACCTCTACCCTTG | 77 | 3104 |

TABLE 41-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1042382 | N/A | N/A | 453115 | 453134 | GATTTCCACAGATTGTTGCT | 66 | 3105 |
| 1042414 | N/A | N/A | 453899 | 453918 | CCTCTAGAACAAAATACATA | 36 | 3106 |
| 1042446 | N/A | N/A | 455060 | 455079 | ATCTGTTTTAAAAGATCCA | 71 | 3107 |
| 1042478 | N/A | N/A | 455364 | 455383 | AACCACAAGCCAACAGGCCT | 114 | 3108 |
| 1042510 | N/A | N/A | 456663 | 456682 | TGTGAGTTCCAAGAAGCAGG | 54 | 3109 |
| 1042542 | N/A | N/A | 457069 | 457088 | CATTTTATTCTTGTTTGATT | 149 | 3110 |

TABLE 42

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 994630 | N/A | N/A | 85516 | 85535 | GTTTGATATGCTATGCTCAC | 12 | 219 |
| 994693 | N/A | N/A | 184184 | 184203 | TCAGGTTTATATGTATACAA | 2 | 149 |
| 994706 | N/A | N/A | 217284 | 217303 | GTTATGTTTAAGGTATTTTC | 5 | 540 |
| 994735 | N/A | N/A | 297005 | 297024 | GTTTGCATTAAATGACTGTG | 1 | 310 |
| 1054946 | 101 | 120 | 2611 | 2630 | CTGTTGCTCTGGCTGCTGCT | 10 | 3111 |
| 1054950 | 110 | 129 | 2620 | 2639 | TTGCGGCTGCTGTTGCTCTG | 14 | 3112 |
| 1054955 | 117 | 136 | 2627 | 2646 | CAATGTCTTGCGGCTGCTGT | 24 | 3113 |
| 1054966 | 248 | 267 | 10659 | 10678 | CCTGGTGACTTGATGCACGA | 25 | 3114 |
| 1054972 | 552 | 571 | 178162 | 178181 | ATCAGTTCCTTGCAGCAGAT | 3 | 3115 |
| 1054978 | 561 | 580 | 178171 | 178190 | CCATAAGCTATCAGTTCCTT | 2 | 3116 |
| 1054983 | 568 | 587 | 178178 | 178197 | TGGAGAACCATAAGCTATCA | 8 | 3117 |
| 1054989 | 586 | 605 | 178196 | 178215 | CATGTGCTTTCATCACAATG | 63 | 3118 |
| 1054994 | 592 | 611 | 178202 | 178221 | CTGTACCATGTGCTTTCATC | 2 | 3119 |
| 1055000 | 3487 | 3506 | 457740 | 457759 | TAAATACTGTGTTATTTTAG | 72 | 3120 |
| 1055004 | 5497 | 5516 | 459750 | 459769 | GGTATTTGTTCAGTTTAGTT | 6 | 3121 |
| 1055008 | 5503 | 5522 | 459756 | 459775 | AAGTCAGGTATTTGTTCAGT | 5 | 3122 |
| 1055014 | 6028 | 6047 | 460281 | 460300 | GTTTAGTGGATCCAGTCAAT | 16 | 3123 |
| 1055018 | 6035 | 6054 | 460288 | 460307 | AGTGTTGGTTTAGTGGATCC | 32 | 3124 |
| 1055023 | 6044 | 6063 | 460297 | 460316 | TCCCATCTTAGTGTTGGTTT | 28 | 3125 |
| 1055029 | 9484 | 9503 | 463737 | 463756 | TTAGAGATTGTTGTTATTGT | 13 | 3126 |
| 1055034 | 9490 | 9509 | 463743 | 463762 | AAATTCTTAGAGATTGTTGT | 14 | 3127 |
| 1055039 | 10090 | 10109 | 464343 | 464362 | TGATCTGATATTAAAACATC | 78 | 3128 |
| 1055044 | 10097 | 10116 | 464350 | 464369 | TGGGTAATGATCTGATATTA | 13 | 3129 |

TABLE 42-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055050 | 10106 | 10125 | 464359 | 464378 | GGCATATGGTGGGTAATGAT | 12 | 3130 |
| 1055056 | 196 | 215 | 9912 | 9931 | AGTAGTTTTTGTGAGGTAAA | 11 | 3131 |
| 1055060 | 202 | 221 | 9918 | 9937 | GCTTGTAGTAGTTTTTGTGA | 29 | 3132 |
| 1055064 | N/A | N/A | 17720 | 17739 | TTTTCTATTTGCACTAGCTG | 65 | 3133 |
| 1055070 | N/A | N/A | 17728 | 17747 | ATGTCACCTTTTCTATTTGC | 3 | 3134 |
| 1055076 | N/A | N/A | 24689 | 24708 | AAACACTAGAAATCCAGGGA | 7 | 3135 |
| 1055082 | N/A | N/A | 85508 | 85527 | TGCTATGCTCACAGAGAACC | 78 | 3136 |
| 1055093 | N/A | N/A | 85524 | 85543 | TACAGTTAGTTTGATATGCT | 25 | 3137 |
| 1055098 | N/A | N/A | 108194 | 108213 | GGAATAAATTATTTACTGCG | 5 | 3138 |
| 1055104 | N/A | N/A | 148323 149434 | 148342 149453 | TACTATGTATTTGCCACAGT | 6 | 3139 |
| 1055110 | N/A | N/A | 179786 | 179805 | ATATTTAATCATGTTCCCGA | 13 | 3140 |
| 1055115 | N/A | N/A | 179792 | 179811 | ATAGTTATATTTAATCATGT | 67 | 3141 |
| 1055120 | N/A | N/A | 184176 | 184195 | ATATGTATACAATTCTGACA | 38 | 3142 |
| 1055131 | N/A | N/A | 184192 | 184211 | CAATGTTCTCAGGTTTATAT | 15 | 3143 |
| 1055137 | N/A | N/A | 203033 | 203052 | CCTTTCTTCTTTGTTCATAG | 6 | 3144 |
| 1055142 | N/A | N/A | 203039 | 203058 | CTTGTTCCTTTCTTCTTTGT | 31 | 3145 |
| 1055148 | N/A | N/A | 203883 | 203902 | ATTTATCCTCAGGATGCAAA | 55 | 3146 |
| 1055154 | N/A | N/A | 203892 | 203911 | TTTGTTTAGATTTATCCTCA | 6 | 3147 |
| 1055159 | N/A | N/A | 210724 | 210743 | ATACTCCATTTTTCCTTCTA | 19 | 3148 |
| 1055164 | N/A | N/A | 210731 | 210750 | ATGTGTAATACTCCATTTTT | 25 | 3149 |
| 1055170 | N/A | N/A | 210740 | 210759 | TTATTACAAATGTGTAATAC | 107 | 3150 |
| 1055176 | N/A | N/A | 212029 | 212048 | TATGTTAGTCATTTCTCTCT | 28 | 3151 |
| 1055181 | N/A | N/A | 212035 | 212054 | CAAGTCTATGTTAGTCATTT | 10 | 3152 |
| 1055187 | N/A | N/A | 217276 | 217295 | TAAGGTATTTTCATGGAGTT | 12 | 3153 |
| 1055198 | N/A | N/A | 217292 | 217311 | TTGTAACAGTTATGTTTAAG | 43 | 3154 |
| 1055204 | N/A | N/A | 226990 | 227009 | TTTACTCATTCTACCTTCAA | 66 | 3155 |
| 1055209 | N/A | N/A | 226997 | 227016 | TTGGTTATTTACTCATTCTA | 20 | 3156 |
| 1055215 | N/A | N/A | 227006 | 227025 | TCCATAAACTTGGTTATTTA | 25 | 3157 |
| 1055221 | N/A | N/A | 251494 | 251513 | TTAGCTTTTCAAATACTAAA | 91 | 3158 |
| 1055227 | N/A | N/A | 251503 | 251522 | TCAGCATACTTAGCTTTTCA | 11 | 3159 |
| 1055232 | N/A | N/A | 251510 | 251529 | GACAGTGTCAGCATACTTAG | 12 | 3160 |
| 1055238 | N/A | N/A | 273793 | 273812 | TACCCAGGTTATTACACTGT | 116 | 3161 |
| 1055244 | N/A | N/A | 284229 | 284248 | TTGGGTTTTTCTGTACAAAG | 1 | 3162 |
| 1055249 | N/A | N/A | 284235 | 284254 | TTTTGTTTGGGTTTTTCTGT | 1 | 3163 |
| 1055255 | N/A | N/A | 284335 | 284354 | CTAGTTCTTATCACTATTCA | 7 | 3164 |

TABLE 42-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055260 | N/A | N/A | 284342 | 284361 | ATGTCAACTAGTTCTTATCA | 5 | 3165 |
| 1055266 | N/A | N/A | 284351 | 284370 | GACTAAACAATGTCAACTAG | 12 | 3166 |
| 1055272 | N/A | N/A | 291011 | 291030 | TGGGTTTTTAGTTTTCCTTC | 4 | 3167 |
| 1055277 | N/A | N/A | 291017 | 291036 | AGGTCCTGGGTTTTTAGTTT | 3 | 3168 |
| 1055283 | N/A | N/A | 296997 | 297016 | TAAATGACTGTGGTGCAGCC | 9 | 3169 |
| 1055294 | N/A | N/A | 297013 | 297032 | AAGCCAGTGTTTGCATTAAA | 1 | 3170 |
| 1055300 | N/A | N/A | 306737 | 306756 | AAGGGCCACTAAATCTGACC | 22 | 3171 |
| 1055306 | N/A | N/A | 318477 | 318496 | ATTTCTTTTTTTTTAAGTT | 103 | 3172 |
| 1055311 | N/A | N/A | 318486 | 318505 | GTGTTTGATATTTCTTTTTT | 1 | 3173 |
| 1055317 | N/A | N/A | 318495 | 318514 | CTTTCAAATGTGTTTGATAT | 3 | 3174 |
| 1055323 | N/A | N/A | 332356 | 332375 | TTATAACAATTTGCATAGTC | 4 | 3175 |
| 1055328 | N/A | N/A | 332363 | 332382 | GGGAGTATTATAACAATTTG | 1 | 3176 |
| 1055334 | N/A | N/A | 332372 | 332391 | TATTTTCCAGGGAGTATTAT | 36 | 3177 |
| 1055340 | N/A | N/A | 347819 | 347838 | CATTATCTAGTTTCTGGAAA | 28 | 3178 |
| 1055345 | N/A | N/A | 347825 | 347844 | AATGGTCATTATCTAGTTTC | 7 | 3179 |
| 1055351 | N/A | N/A | 353593 | 353612 | CTAAATCTGACTTACAAAGG | 121 | 3180 |
| 1055357 | N/A | N/A | 377459 | 377478 | TAAAACCAATACATTAACAT | 117 | 3181 |
| 1055363 | N/A | N/A | 410197 | 410216 | CATTATGCTTTAAGATCACA | 5 | 3182 |

TABLE 43

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994311 | 103 | 122 | 2613 | 2632 | TGCTGTTGCTCTGGCTGCTG | 33 | 257 |
| 994313 | 111 | 130 | 2621 | 2640 | CTTGCGGCTGCTGTTGCTCT | 14 | 413 |
| 994328 | 562 | 581 | 178172 | 178191 | ACCATAAGCTATCAGTTCCT | 2 | 337 |
| 994599 | 204 | 223 | 9920 | 9939 | GTGCTTGTAGTAGTTTTTGT | 23 | 293 |
| 994605 | N/A | N/A | 17726 | 17745 | GTCACCTTTTCTATTTGCAC | 1 | 138 |
| 994701 | N/A | N/A | 203893 | 203912 | GTTTGTTTAGATTTATCCTC | 2 | 150 |
| 994717 | N/A | N/A | 251504 | 251523 | GTCAGCATACTTAGCTTTTC | 8 | 152 |
| 1040945 | N/A | N/A | 179793 | 179812 | CATAGTTATATTTAATCATG | 52 | 828 |
| 1054956 | 119 | 138 | 2629 | 2648 | AACAATGTCTTGCGGCTGCT | 24 | 3183 |
| 1054962 | 243 | 262 | 10654 | 10673 | TGACTTGATGCACGATGCTC | 10 | 3184 |
| 1054967 | 249 | 268 | 10660 | 10679 | CCCTGGTGACTTGATGCACG | 23 | 3185 |
| 1054973 | 554 | 573 | 178164 | 178183 | CTATCAGTTCCTTGCAGCAG | 3 | 3186 |

TABLE 43-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1054984 | 570 | 589 | 178180 | 178199 | AATGGAGAACCATAAGCTAT | 26 | 3187 |
| 1054990 | 587 | 606 | 178197 | 178216 | CCATGTGCTTTCATCACAAT | 20 | 3188 |
| 1054995 | 593 | 612 | N/A | N/A | ACTGTACCATGTGCTTTCAT | 1 | 3189 |
| 1055001 | 5489 | 5508 | 459742 | 459761 | TTCAGTTTAGTTGCAGCCAT | 7 | 3190 |
| 1055005 | 5498 | 5517 | 459751 | 459770 | AGGTATTTGTTCAGTTTAGT | 7 | 3191 |
| 1055009 | 5505 | 5524 | 459758 | 459777 | AAAAGTCAGGTATTTGTTCA | 15 | 3192 |
| 1055015 | 6030 | 6049 | 460283 | 460302 | TGGTTTAGTGGATCCAGTCA | 18 | 3193 |
| 1055019 | 6036 | 6055 | 460289 | 460308 | TAGTGTTGGTTTAGTGGATC | 23 | 3194 |
| 1055024 | 9476 | 9495 | 463729 | 463748 | TGTTGTTATTGTATAGATAC | 9 | 3195 |
| 1055030 | 9485 | 9504 | 463738 | 463757 | CTTAGAGATTGTTGTTATTG | 15 | 3196 |
| 1055035 | 9492 | 9511 | 463745 | 463764 | GGAAATTCTTAGAGATTGTT | 12 | 3197 |
| 1055040 | 10092 | 10111 | 464345 | 464364 | AATGATCTGATATTAAAACA | 43 | 3198 |
| 1055045 | 10098 | 10117 | 464351 | 464370 | GTGGGTAATGATCTGATATT | 13 | 3199 |
| 1055051 | 188 | 207 | N/A | N/A | TTGTGAGGTAAAACTGTAAA | 137 | 3200 |
| 1055057 | 197 | 216 | 9913 | 9932 | TAGTAGTTTTGTGAGGTAA | 12 | 3201 |
| 1055065 | N/A | N/A | 17722 | 17741 | CCTTTTCTATTTGCACTAGC | 28 | 3202 |
| 1055071 | N/A | N/A | 17729 | 17748 | AATGTCACCTTTTCTATTTG | 16 | 3203 |
| 1055077 | N/A | N/A | 36482 | 36501 | AACTCTCTTAAGTACTTATA | 16 | 3204 |
| 1055083 | N/A | N/A | 85510 | 85529 | TATGCTATGCTCACAGAGAA | 55 | 3205 |
| 1055088 | N/A | N/A | 85517 | 85536 | AGTTTGATATGCTATGCTCA | 8 | 3206 |
| 1055094 | N/A | N/A | 85526 | 85545 | CTTACAGTTAGTTTGATATG | 26 | 3207 |
| 1055099 | N/A | N/A | 125427 | 125446 | AGCTTCCAGATAAAACCTCC | 61 | 3208 |
| 1055105 | N/A | N/A | 179272 | 179291 | TTCAAAATTCTCAGCATTGG | 5 | 3209 |
| 1055111 | N/A | N/A | 179787 | 179806 | TATATTTAATCATGTTCCCG | 13 | 3210 |
| 1055121 | N/A | N/A | 184178 | 184197 | TTATATGTATACAATTCTGA | 67 | 3211 |
| 1055126 | N/A | N/A | 184185 | 184204 | CTCAGGTTTATATGTATACA | 1 | 3212 |
| 1055132 | N/A | N/A | 184194 | 184213 | GGCAATGTTCTCAGGTTTAT | 1 | 3213 |
| 1055138 | N/A | N/A | 203034 | 203053 | TCCTTTCTTCTTTGTTCATA | 9 | 3214 |
| 1055143 | N/A | N/A | 203040 | 203059 | TCTTGTTCCTTTCTTCTTTG | 20 | 3215 |
| 1055149 | N/A | N/A | 203885 | 203904 | AGATTTATCCTCAGGATGCA | 26 | 3216 |
| 1055160 | N/A | N/A | 210726 | 210745 | TAATACTCCATTTTTCCTTC | 25 | 3217 |
| 1055165 | N/A | N/A | 210732 | 210751 | AATGTGTAATACTCCATTTT | 51 | 3218 |
| 1055171 | N/A | N/A | 212021 | 212040 | TCATTTCTCTCTGGCTGTGC | 27 | 3219 |
| 1055177 | N/A | N/A | 212030 | 212049 | CTATGTTAGTCATTTCTCTC | 15 | 3220 |
| 1055182 | N/A | N/A | 212037 | 212056 | ATCAAGTCTATGTTAGTCAT | 11 | 3221 |
| 1055188 | N/A | N/A | 217278 | 217297 | TTTAAGGTATTTTCATGGAG | 7 | 3222 |

TABLE 43-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055193 | N/A | N/A | 217285 | 217304 | AGTTATGTTTAAGGTATTTT | 53 | 3223 |
| 1055199 | N/A | N/A | 217294 | 217313 | ACTTGTAACAGTTATGTTTA | 44 | 3224 |
| 1055205 | N/A | N/A | 226992 | 227011 | TATTTACTCATTCTACCTTC | 63 | 3225 |
| 1055210 | N/A | N/A | 226998 | 227017 | CTTGGTTATTTACTCATTCT | 21 | 3226 |
| 1055216 | N/A | N/A | 228677 | 228696 | GGCTGATTCTAGTACTGTGA | 51 | 3227 |
| 1055222 | N/A | N/A | 251496 | 251515 | ACTTAGCTTTTCAAATACTA | 30 | 3228 |
| 1055233 | N/A | N/A | 251512 | 251531 | AGGACAGTGTCAGCATACTT | 14 | 3229 |
| 1055239 | N/A | N/A | 284221 | 284240 | TTCTGTACAAAGTTCAGTTG | 54 | 3230 |
| 1055245 | N/A | N/A | 284230 | 284249 | TTTGGGTTTTTCTGTACAAA | <1 | 3231 |
| 1055250 | N/A | N/A | 284237 | 284256 | AGTTTTGTTTGGGTTTTTCT | <1 | 3232 |
| 1055256 | N/A | N/A | 284337 | 284356 | AACTAGTTCTTATCACTATT | 37 | 3233 |
| 1055261 | N/A | N/A | 284343 | 284362 | AATGTCAACTAGTTCTTATC | 2 | 3234 |
| 1055267 | N/A | N/A | 288842 | 288861 | TATAAAATTCACCTAAAATT | 110 | 3235 |
| 1055273 | N/A | N/A | 291012 | 291031 | CTGGGTTTTTAGTTTTCCTT | 1 | 3236 |
| 1055278 | N/A | N/A | 291018 | 291037 | TAGGTCCTGGGTTTTTAGTT | 3 | 3237 |
| 1055284 | N/A | N/A | 296999 | 297018 | ATTAAATGACTGTGGTGCAG | 3 | 3238 |
| 1055289 | N/A | N/A | 297006 | 297025 | TGTTTGCATTAAATGACTGT | 27 | 3239 |
| 1055295 | N/A | N/A | 297015 | 297034 | AAAAGCCAGTGTTTGCATTA | 2 | 3240 |
| 1055301 | N/A | N/A | 306738 306824 | 306757 306843 | TAAGGGCCACTAAATCTGAC | 12 | 3241 |
| 1055307 | N/A | N/A | 318479 | 318498 | ATATTTCTTTTTTTTTAAG | 134 | 3242 |
| 1055312 | N/A | N/A | 318487 | 318506 | TGTGTTTGATATTTCTTTTT | <1 | 3243 |
| 1055318 | N/A | N/A | 318632 | 318651 | ATGCAAGGTCCAGGGAATAC | 1 | 3244 |
| 1055324 | N/A | N/A | 332358 | 332377 | TATTATAACAATTTGCATAG | 46 | 3245 |
| 1055329 | N/A | N/A | 332364 | 332383 | AGGGAGTATTATAACAATTT | 1 | 3246 |
| 1055335 | N/A | N/A | 333552 | 333571 | TATGAGTAATTAGCACAAAG | 11 | 3247 |
| 1055341 | N/A | N/A | 347820 | 347839 | TCATTATCTAGTTTCTGGAA | 6 | 3248 |
| 1055346 | N/A | N/A | 347826 | 347845 | AAATGGTCATTATCTAGTTT | 5 | 3249 |
| 1055352 | N/A | N/A | 353767 | 353786 | ACTTCCAATTTTGAAATACT | 10 | 3250 |
| 1055358 | N/A | N/A | 389235 | 389254 | GAAAGCCCCAGCACATAAAT | 114 | 3251 |
| 1055364 | N/A | N/A | 420350 | 420369 | TGAAAGCTGGCCGATATCCC | 65 | 3252 |

TABLE 44

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994312 | 105 | 124 | 2615 | 2634 | GCTGCTGTTGCTCTGGCTGC | 48 | 335 |
| 994447 | 5491 | 5510 | 459744 | 459763 | TGTTCAGTTTAGTTGCAGCC | 12 | 274 |
| 994449 | 5499 | 5518 | 459752 | 459771 | CAGGTATTTGTTCAGTTTAG | 8 | 430 |
| 994561 | 9486 | 9505 | 463739 | 463758 | TCTTAGAGATTGTTGTTATT | 13 | 444 |
| 994597 | 198 | 217 | 9914 | 9933 | GTAGTAGTTTTTGTGAGGTA | 10 | 137 |
| 994601 | 206 | 225 | 9922 | 9941 | TGGTGCTTGTAGTAGTTTTT | 31 | 449 |
| 994605 | N/A | N/A | 17726 | 17745 | GTCACCTTTTCTATTTGCAC | 2 | 138 |
| 994703 | N/A | N/A | 212031 | 212050 | TCTATGTTAGTCATTTCTCT | 21 | 306 |
| 994731 | N/A | N/A | 284231 | 284250 | GTTTGGGTTTTTCTGTACAA | 2 | 621 |
| 1040848 | N/A | N/A | 96129 | 96148 | CACTTTCTAGATTATTCTTA | 102 | 748 |
| 1054951 | 112 | 131 | 2622 | 2641 | TCTTGCGGCTGCTGTTGCTC | 14 | 3253 |
| 1054957 | 121 | 140 | 2631 | 2650 | GAAACAATGTCTTGCGGCTG | 15 | 3254 |
| 1054963 | 244 | 263 | 10655 | 10674 | GTGACTTGATGCACGATGCT | 8 | 3255 |
| 1054968 | 250 | 269 | 10661 | 10680 | ACCCTGGTGACTTGATGCAC | 20 | 3256 |
| 1054974 | 556 | 575 | 178166 | 178185 | AGCTATCAGTTCCTTGCAGC | 11 | 3257 |
| 1054979 | 563 | 582 | 178173 | 178192 | AACCATAAGCTATCAGTTCC | 7 | 3258 |
| 1054985 | 572 | 591 | 178182 | 178201 | ACAATGGAGAACCATAAGCT | 101 | 3259 |
| 1054991 | 588 | 607 | 178198 | 178217 | ACCATGTGCTTTCATCACAA | 3 | 3260 |
| 1054996 | 594 | 613 | N/A | N/A | AACTGTACCATGTGCTTTCA | 3 | 3261 |
| 1055010 | 5507 | 5526 | 459760 | 459779 | AGAAAAGTCAGGTATTTGTT | 14 | 3262 |
| 1055016 | 6031 | 6050 | 460284 | 460303 | TTGGTTTAGTGGATCCAGTC | 31 | 3263 |
| 1055020 | 6037 | 6056 | 460290 | 460309 | TTAGTGTTGGTTTAGTGGAT | 20 | 3264 |
| 1055025 | 9478 | 9497 | 463731 | 463750 | ATTGTTGTTATTGTATAGAT | 18 | 3265 |
| 1055036 | 9494 | 9513 | 463747 | 463766 | ATGGAAATTCTTAGAGATTG | 16 | 3266 |
| 1055041 | 10093 | 10112 | 464346 | 464365 | TAATGATCTGATATTAAAAC | 111 | 3267 |
| 1055046 | 10099 | 10118 | 464352 | 464371 | GGTGGGTAATGATCTGATAT | 34 | 3268 |
| 1055052 | 190 | 209 | N/A | N/A | TTTTGTGAGGTAAAACTGTA | 136 | 3269 |
| 1055066 | N/A | N/A | 17723 | 17742 | ACCTTTTCTATTTGCACTAG | 19 | 3270 |
| 1055072 | N/A | N/A | 17730 | 17749 | AAATGTCACCTTTTCTATTT | 56 | 3271 |
| 1055078 | N/A | N/A | 36986 | 37005 | GCTATTTTTCCAGAAAGTC | 6 | 3272 |
| 1055084 | N/A | N/A | 85512 | 85531 | GATATGCTATGCTCACAGAG | 23 | 3273 |
| 1055089 | N/A | N/A | 85518 | 85537 | TAGTTTGATATGCTATGCTC | 33 | 3274 |
| 1055100 | N/A | N/A | 133992 | 134011 | AATTTTTTTAACATCTTGC | 88 | 3275 |
| 1055106 | N/A | N/A | 179779 | 179798 | ATCATGTTCCCGATATTGGA | 15 | 3276 |
| 1055112 | N/A | N/A | 179788 | 179807 | TTATATTTAATCATGTTCCC | 11 | 3277 |
| 1055116 | N/A | N/A | 179795 | 179814 | AACATAGTTATATTTAATCA | 132 | 3278 |

TABLE 44-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055122 | N/A | N/A | 184180 | 184199 | GTTTATATGTATACAATTCT | 26 | 3279 |
| 1055127 | N/A | N/A | 184186 | 184205 | TCTCAGGTTTATATGTATAC | 4 | 3280 |
| 1055133 | N/A | N/A | 187811 | 187830 | TCACAGGGAATAATGAAGAG | 73 | 3281 |
| 1055139 | N/A | N/A | 203035 | 203054 | TTCCTTTCTTCTTTGTTCAT | 45 | 3282 |
| 1055144 | N/A | N/A | 203041 | 203060 | CTCTTGTTCCTTTCTTCTTT | 20 | 3283 |
| 1055150 | N/A | N/A | 203887 | 203906 | TTAGATTTATCCTCAGGATG | 51 | 3284 |
| 1055155 | N/A | N/A | 203894 | 203913 | GGTTTGTTTAGATTTATCCT | 11 | 3285 |
| 1055161 | N/A | N/A | 210727 | 210746 | GTAATACTCCATTTTCCTT | 4 | 3286 |
| 1055166 | N/A | N/A | 210733 | 210752 | AAATGTGTAATACTCCATTT | 53 | 3287 |
| 1055172 | N/A | N/A | 212023 | 212042 | AGTCATTTCTCTCTGGCTGT | 53 | 3288 |
| 1055183 | N/A | N/A | 212039 | 212058 | AAATCAAGTCTATGTTAGTC | 63 | 3289 |
| 1055189 | N/A | N/A | 217280 | 217299 | TGTTTAAGGTATTTTCATGG | 8 | 3290 |
| 1055194 | N/A | N/A | 217286 | 217305 | CAGTTATGTTTAAGGTATTT | 19 | 3291 |
| 1055200 | N/A | N/A | 222603 | 222622 | CTGTTCTTAGCTTCCCAGCT | 39 | 3292 |
| 1055206 | N/A | N/A | 226993 | 227012 | TTATTTACTCATTCTACCTT | 82 | 3293 |
| 1055211 | N/A | N/A | 226999 | 227018 | ACTTGGTTATTTACTCATTC | 17 | 3294 |
| 1055217 | N/A | N/A | 230285 | 230304 | AATCTCCAGTTATGAGTAAG | 82 | 3295 |
| 1055223 | N/A | N/A | 251498 | 251517 | ATACTTAGCTTTTCAAATAC | 83 | 3296 |
| 1055228 | N/A | N/A | 251505 | 251524 | TGTCAGCATACTTAGCTTTT | 32 | 3297 |
| 1055234 | N/A | N/A | 251514 | 251533 | CCAGGACAGTGTCAGCATAC | 29 | 3298 |
| 1055240 | N/A | N/A | 284223 | 284242 | TTTTCTGTACAAAGTTCAGT | 4 | 3299 |
| 1055251 | N/A | N/A | 284239 | 284258 | TTAGTTTTGTTTGGGTTTTT | 2 | 3300 |
| 1055257 | N/A | N/A | 284338 | 284357 | CAACTAGTTCTTATCACTAT | 15 | 3301 |
| 1055262 | N/A | N/A | 284344 | 284363 | CAATGTCAACTAGTTCTTAT | 4 | 3302 |
| 1055268 | N/A | N/A | 291004 | 291023 | TTAGTTTTCCTTCTTGTCTT | 7 | 3303 |
| 1055274 | N/A | N/A | 291013 | 291032 | CCTGGGTTTTAGTTTTCCT | 3 | 3304 |
| 1055279 | N/A | N/A | 291020 | 291039 | ATTAGGTCCTGGGTTTTTAG | 3 | 3305 |
| 1055285 | N/A | N/A | 297001 | 297020 | GCATTAAATGACTGTGGTGC | 5 | 3306 |
| 1055290 | N/A | N/A | 297007 | 297026 | GTGTTTGCATTAAATGACTG | 4 | 3307 |
| 1055296 | N/A | N/A | 306730 | 306749 | ACTAAATCTGACCTTCCTCA | 35 | 3308 |
| 1055302 | N/A | N/A | 306741 306827 | 306760 306846 | TGGTAAGGGCCACTAAATCT | 4 | 3309 |
| 1055308 | N/A | N/A | 318481 | 318500 | TGATATTTCTTTTTTTTTA | 104 | 3310 |
| 1055313 | N/A | N/A | 318488 | 318507 | ATGTGTTTGATATTTCTTTT | 1 | 3311 |
| 1055319 | N/A | N/A | 324476 | 324495 | TGATCTAAATTGTGTCTTTT | 17 | 3312 |
| 1055325 | N/A | N/A | 332359 | 332378 | GTATTATAACAATTTGCATA | 6 | 3313 |
| 1055330 | N/A | N/A | 332365 | 332384 | CAGGGAGTATTATAACAATT | 2 | 3314 |

TABLE 44-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055336 | N/A | N/A | 334250 | 334269 | TCATAGAAGCATTCTGTGTT | 90 | 3315 |
| 1055342 | N/A | N/A | 347821 | 347840 | GTCATTATCTAGTTTCTGGA | 2 | 3316 |
| 1055347 | N/A | N/A | 347827 | 347846 | CAAATGGTCATTATCTAGTT | 10 | 3317 |
| 1055353 | N/A | N/A | 355980 | 355999 | ATCTGCTAGGCATGCGGGAT | 27 | 3318 |
| 1055359 | N/A | N/A | 396488 | 396507 | TGATTTGTACACACCCAGCA | 62 | 3319 |
| 1055365 | N/A | N/A | 432459 | 432478 | GCACTGATCCAATAAAACCC | 93 | 3320 |

TABLE 45

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994605 | N/A | N/A | 17726 | 17745 | GTCACCTTTTCTATTTGCAC | 2 | 138 |
| 994690 | N/A | N/A | 179789 | 179808 | GTTATATTTAATCATGTTCC | 4 | 538 |
| 994734 | N/A | N/A | 291014 | 291033 | TCCTGGGTTTTTAGTTTTCC | 2 | 232 |
| 1041358 | N/A | N/A | 438300 | 438319 | GAGAGTATAAAAATTATCTC | 93 | 3073 |
| 1054947 | 107 | 126 | 2617 | 2636 | CGGCTGCTGTTGCTCTGGCT | 25 | 3321 |
| 1054952 | 113 | 132 | 2623 | 2642 | GTCTTGCGGCTGCTGTTGCT | 16 | 3322 |
| 1054964 | 245 | 264 | 10656 | 10675 | GGTGACTTGATGCACGATGC | 7 | 3323 |
| 1054969 | 252 | 271 | 10663 | 10682 | CCACCCTGGTGACTTGATGC | 13 | 3324 |
| 1054975 | 558 | 577 | 178168 | 178187 | TAAGCTATCAGTTCCTTGCA | 5 | 3325 |
| 1054980 | 564 | 583 | 178174 | 178193 | GAACCATAAGCTATCAGTTC | 24 | 3326 |
| 1054986 | 580 | 599 | 178190 | 178209 | CTTTCATCACAATGGAGAAC | 101 | 3327 |
| 1054992 | 589 | 608 | 178199 | 178218 | TACCATGTGCTTTCATCACA | 6 | 3328 |
| 1054997 | 596 | 615 | N/A | N/A | AAAACTGTACCATGTGCTTT | 4 | 3329 |
| 1055002 | 5493 | 5512 | 459746 | 459765 | TTTGTTCAGTTTAGTTGCAG | 17 | 3330 |
| 1055006 | 5500 | 5519 | 459753 | 459772 | TCAGGTATTTGTTCAGTTTA | 6 | 3331 |
| 1055011 | 5509 | 5528 | 459762 | 459781 | AAAGAAAAGTCAGGTATTTG | 42 | 3332 |
| 1055017 | 6032 | 6051 | 460285 | 460304 | GTTGGTTTAGTGGATCCAGT | 42 | 3333 |
| 1055021 | 6038 | 6057 | 460291 | 460310 | CTTAGTGTTGGTTTAGTGGA | 28 | 3334 |
| 1055026 | 9480 | 9499 | 463733 | 463752 | AGATTGTTGTTATTGTATAG | 20 | 3335 |
| 1055031 | 9487 | 9506 | 463740 | 463759 | TTCTTAGAGATTGTTGTTAT | 20 | 3336 |
| 1055037 | 9496 | 9515 | 463749 | 463768 | TTATGGAAATTCTTAGAGAT | 67 | 3337 |
| 1055042 | 10094 | 10113 | 464347 | 464366 | GTAATGATCTGATATTAAAA | 54 | 3338 |
| 1055047 | 10100 | 10119 | 464353 | 464372 | TGGTGGGTAATGATCTGATA | 14 | 3339 |

TABLE 45-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055053 | 192 | 211 | N/A | N/A | GTTTTTGTGAGGTAAAACTG | 111 | 3340 |
| 1055058 | 199 | 218 | 9915 | 9934 | TGTAGTAGTTTTTGTGAGGT | 19 | 3341 |
| 1055061 | 208 | 227 | 9924 | 9943 | CTTGGTGCTTGTAGTAGTTT | 25 | 3342 |
| 1055067 | N/A | N/A | 17724 | 17743 | CACCTTTTCTATTTGCACTA | 23 | 3343 |
| 1055073 | N/A | N/A | 17732 | 17751 | TCAAATGTCACCTTTTCTAT | 52 | 3344 |
| 1055079 | N/A | N/A | 49576 | 49595 | ATAGCAAGTCCCCTGAAGCT | 83 | 3345 |
| 1055085 | N/A | N/A | 85513 | 85532 | TGATATGCTATGCTCACAGA | 25 | 3346 |
| 1055090 | N/A | N/A | 85519 | 85538 | TTAGTTTGATATGCTATGCT | 36 | 3347 |
| 1055095 | N/A | N/A | 99353 | 99372 | CACAGAACACTTTTTCCAGA | 41 | 3348 |
| 1055101 | N/A | N/A | 144499 | 144518 | ATCACACAGCAGCATGTTTA | 72 | 3349 |
| 1055107 | N/A | N/A | 179781 | 179800 | TAATCATGTTCCCGATATTG | 21 | 3350 |
| 1055117 | N/A | N/A | 179797 | 179816 | CTAACATAGTTATATTTAAT | 121 | 3351 |
| 1055123 | N/A | N/A | 184181 | 184200 | GGTTTATATGTATACAATTC | 3 | 3352 |
| 1055128 | N/A | N/A | 184187 | 184206 | TTCTCAGGTTTATATGTATA | 5 | 3353 |
| 1055134 | N/A | N/A | 203027 | 203046 | TTCTTTGTTCATAGGAGAAC | 91 | 3354 |
| 1055140 | N/A | N/A | 203036 | 203055 | GTTCCTTTCTTCTTTGTTCA | 17 | 3355 |
| 1055145 | N/A | N/A | 203043 | 203062 | ACCTCTTGTTCCTTTCTTCT | 10 | 3356 |
| 1055151 | N/A | N/A | 203889 | 203908 | GTTTAGATTATCCTCAGGA | 3 | 3357 |
| 1055156 | N/A | N/A | 203895 | 203914 | GGGTTTGTTTAGATTTATCC | 19 | 3358 |
| 1055162 | N/A | N/A | 210728 | 210747 | TGTAATACTCCATTTTTCCT | 15 | 3359 |
| 1055167 | N/A | N/A | 210734 | 210753 | CAAATGTGTAATACTCCATT | 16 | 3360 |
| 1055173 | N/A | N/A | 212025 | 212044 | TTAGTCATTTCTCTCTGGCT | 50 | 3361 |
| 1055178 | N/A | N/A | 212032 | 212051 | GTCTATGTTAGTCATTTCTC | 13 | 3362 |
| 1055184 | N/A | N/A | 212041 | 212060 | AAAAATCAAGTCTATGTTAG | 118 | 3363 |
| 1055190 | N/A | N/A | 217281 | 217300 | ATGTTTAAGGTATTTTCATG | 41 | 3364 |
| 1055195 | N/A | N/A | 217287 | 217306 | ACAGTTATGTTTAAGGTATT | 39 | 3365 |
| 1055201 | N/A | N/A | 226199 | 226218 | AAAACAGACTTCGATTTGGA | 70 | 3366 |
| 1055207 | N/A | N/A | 226994 | 227013 | GTTATTTACTCATTCTACCT | 42 | 3367 |
| 1055212 | N/A | N/A | 227000 | 227019 | AACTTGGTTATTTACTCATT | 25 | 3368 |
| 1055218 | N/A | N/A | 233991 | 234010 | AAGTTGGAGAAGTCACCAGC | 103 | 3369 |
| 1055224 | N/A | N/A | 251500 | 251519 | GCATACTTAGCTTTTCAAAT | 6 | 3370 |
| 1055229 | N/A | N/A | 251506 | 251525 | GTGTCAGCATACTTAGCTTT | 27 | 3371 |
| 1055235 | N/A | N/A | 254560 | 254579 | TCTTGGAGGTGACATTTGTG | 55 | 3372 |
| 1055241 | N/A | N/A | 284225 | 284244 | GTTTTTCTGTACAAAGTTCA | 2 | 3373 |
| 1055246 | N/A | N/A | 284232 | 284251 | TGTTTGGTTTTTCTGTACA | 1 | 3374 |
| 1055252 | N/A | N/A | 284241 | 284260 | CTTTAGTTTTGTTTGGGTTT | 2 | 3375 |

TABLE 45-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055258 | N/A | N/A | 284339 | 284358 | TCAACTAGTTCTTATCACTA | 4 | 3376 |
| 1055263 | N/A | N/A | 284345 | 284364 | ACAATGTCAACTAGTTCTTA | 2 | 3377 |
| 1055269 | N/A | N/A | 291006 | 291025 | TTTTAGTTTTCCTTCTTGTC | 5 | 3378 |
| 1055280 | N/A | N/A | 291022 | 291041 | AGATTAGGTCCTGGGTTTTT | 2 | 3379 |
| 1055286 | N/A | N/A | 297002 | 297021 | TGCATTAAATGACTGTGGTG | 4 | 3380 |
| 1055291 | N/A | N/A | 297008 | 297027 | AGTGTTTGCATTAAATGACT | 5 | 3381 |
| 1055297 | N/A | N/A | 306732 | 306751 | CCACTAAATCTGACCTTCCT | 37 | 3382 |
| 1055303 | N/A | N/A | 306746 | 306765 | TCCATTGGTAAGGGCCACTA | 2 | 3383 |
| 1055309 | N/A | N/A | 318483 | 318502 | TTTGATATTTCTTTTTTTTT | 96 | 3384 |
| 1055314 | N/A | N/A | 318489 | 318508 | AATGTGTTTGATATTTCTTT | 1 | 3385 |
| 1055320 | N/A | N/A | 326832 | 326851 | CAGTTTTGAGATGGTTTGAA | 3 | 3386 |
| 1055326 | N/A | N/A | 332360 | 332379 | AGTATTATAACAATTTGCAT | 22 | 3387 |
| 1055331 | N/A | N/A | 332366 | 332385 | CCAGGGAGTATTATAACAAT | 2 | 3388 |
| 1055337 | N/A | N/A | 347813 | 347832 | CTAGTTTCTGGAAAGTAATG | 36 | 3389 |
| 1055343 | N/A | N/A | 347822 | 347841 | GGTCATTATCTAGTTTCTGG | 1 | 3390 |
| 1055348 | N/A | N/A | 347829 | 347848 | AACAAATGGTCATTATCTAG | 9 | 3391 |
| 1055354 | N/A | N/A | 358326 | 358345 | CCAAATTCCTGGTTGCTGTG | 4 | 3392 |
| 1055360 | N/A | N/A | 397561 | 397580 | AGGGCCTCTTGGATTTTGTT | 130 | 3393 |

TABLE 46

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994314 | 246 | 265 | 10657 | 10676 | TGGTGACTTGATGCACGATG | 12 | 491 |
| 994329 | 590 | 609 | 178200 | 178219 | GTACCATGTGCTTTCATCAC | 5 | 415 |
| 994465 | 6033 | 6052 | 460286 | 460305 | TGTTGGTTTAGTGGATCCAG | 21 | 432 |
| 994467 | 6040 | 6059 | 460293 | 460312 | ATCTTAGTGTTGGTTTAGTG | 20 | 588 |
| 994605 | N/A | N/A | 17726 | 17745 | GTCACCTTTTCTATTTGCAC | 4 | 138 |
| 994700 | N/A | N/A | 203037 | 203056 | TGTTCCTTTCTTCTTTGTTC | 10 | 72 |
| 994761 | N/A | N/A | 347823 | 347842 | TGGTCATTATCTAGTTTCTG | 2 | 469 |
| 1054948 | 108 | 127 | 2618 | 2637 | GCGGCTGCTGTTGCTCTGGC | 57 | 3394 |
| 1054953 | 114 | 133 | 2624 | 2643 | TGTCTTGCGGCTGCTGTTGC | 16 | 3395 |
| 1054970 | 254 | 273 | 10665 | 10684 | GACCACCCTGGTGACTTGAT | 9 | 3396 |
| 1054976 | 559 | 578 | 178169 | 178188 | ATAAGCTATCAGTTCCTTGC | 11 | 3397 |
| 1054981 | 565 | 584 | 178175 | 178194 | AGAACCATAAGCTATCAGTT | 7 | 3398 |

TABLE 46-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1054987 | 582 | 601 | 178192 | 178211 | TGCTTTCATCACAATGGAGA | 62 | 3399 |
| 1054998 | 598 | 617 | N/A | N/A | GGAAAACTGTACCATGTGCT | 4 | 3400 |
| 1055003 | 5495 | 5514 | 459748 | 459767 | TATTTGTTCAGTTTAGTTGC | 9 | 3401 |
| 1055007 | 5501 | 5520 | 459754 | 459773 | GTCAGGTATTTGTTCAGTTT | 9 | 3402 |
| 1055012 | 6024 | 6043 | 460277 | 460296 | AGTGGATCCAGTCAATTCAA | 34 | 3403 |
| 1055027 | 9482 | 9501 | 463735 | 463754 | AGAGATTGTTGTTATTGTAT | 16 | 3404 |
| 1055032 | 9488 | 9507 | 463741 | 463760 | ATTCTTAGAGATTGTTGTTA | 21 | 3405 |
| 1055038 | 10086 | 10105 | 464339 | 464358 | CTGATATTAAAACATCCAGT | 21 | 3406 |
| 1055043 | 10095 | 10114 | 464348 | 464367 | GGTAATGATCTGATATTAAA | 15 | 3407 |
| 1055048 | 10102 | 10121 | 464355 | 464374 | TATGGTGGGTAATGATCTGA | 16 | 3408 |
| 1055054 | 194 | 213 | 9910 | 9929 | TAGTTTTTGTGAGGTAAAAC | 83 | 3409 |
| 1055059 | 200 | 219 | 9916 | 9935 | TTGTAGTAGTTTTGTGAGG | 28 | 3410 |
| 1055062 | N/A | N/A | 17716 | 17735 | CTATTTGCACTAGCTGCCTA | 75 | 3411 |
| 1055068 | N/A | N/A | 17725 | 17744 | TCACCTTTTCTATTTGCACT | 10 | 3412 |
| 1055074 | N/A | N/A | 17734 | 17753 | TCTCAAATGTCACCTTTTCT | 44 | 3413 |
| 1055080 | N/A | N/A | 54036 | 54055 | AACCATATGACATCTCAACA | 33 | 3414 |
| 1055086 | N/A | N/A | 85514 | 85533 | TTGATATGCTATGCTCACAG | 18 | 3415 |
| 1055091 | N/A | N/A | 85520 | 85539 | GTTAGTTTGATATGCTATGC | 36 | 3416 |
| 1055096 | N/A | N/A | 103883 | 103902 | CAACTGAAAATTCTACACAC | 110 | 3417 |
| 1055102 | N/A | N/A | 147181 | 147200 | CAGTAGTCTCCCCATAGCCA | 76 | 3418 |
| 1055108 | N/A | N/A | 179783 | 179802 | TTTAATCATGTTCCCGATAT | 57 | 3419 |
| 1055113 | N/A | N/A | 179790 | 179809 | AGTTATATTTAATCATGTTC | 17 | 3420 |
| 1055118 | N/A | N/A | 179799 | 179818 | CACTAACATAGTTATATTTA | 72 | 3421 |
| 1055124 | N/A | N/A | 184182 | 184201 | AGGTTATATGTATACAATT | 13 | 3422 |
| 1055129 | N/A | N/A | 184188 | 184207 | GTTCTCAGGTTTATATGTAT | 5 | 3423 |
| 1055135 | N/A | N/A | 203029 | 203048 | TCTTCTTTGTTCATAGGAGA | 147 | 3424 |
| 1055146 | N/A | N/A | 203045 | 203064 | CAACCTCTTGTTCCTTTCTT | 52 | 3425 |
| 1055152 | N/A | N/A | 203890 | 203909 | TGTTTAGATTATCCTCAGG | 5 | 3426 |
| 1055157 | N/A | N/A | 210720 | 210739 | TCCATTTTTCCTTCTAGATT | 19 | 3427 |
| 1055163 | N/A | N/A | 210729 | 210748 | GTGTAATACTCCATTTTTCC | 5 | 3428 |
| 1055168 | N/A | N/A | 210736 | 210755 | TACAAATGTGTAATACTCCA | 6 | 3429 |
| 1055174 | N/A | N/A | 212027 | 212046 | TGTTAGTCATTTCTCTCTGG | 23 | 3430 |
| 1055179 | N/A | N/A | 212033 | 212052 | AGTCTATGTTAGTCATTTCT | 24 | 3431 |
| 1055185 | N/A | N/A | 213048 | 213067 | GATGATAAATTAAGGCAGAG | 22 | 3432 |
| 1055191 | N/A | N/A | 217282 | 217301 | TATGTTTAAGGTATTTTCAT | 47 | 3433 |
| 1055196 | N/A | N/A | 217288 | 217307 | AACAGTTATGTTTAAGGTAT | 43 | 3434 |

TABLE 46-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055202 | N/A | N/A | 226986 | 227005 | CTCATTCTACCTTCAACTCT | 94 | 3435 |
| 1055208 | N/A | N/A | 226995 | 227014 | GGTTATTTACTCATTCTACC | 14 | 3436 |
| 1055213 | N/A | N/A | 227002 | 227021 | TAAACTTGGTTATTTACTCA | 79 | 3437 |
| 1055219 | N/A | N/A | 236034 | 236053 | GAGTGAGCATTAGATGGTCA | 56 | 3438 |
| 1055225 | N/A | N/A | 251501 | 251520 | AGCATACTTAGCTTTTCAAA | 10 | 3439 |
| 1055230 | N/A | N/A | 251507 | 251526 | AGTGTCAGCATACTTAGCTT | 16 | 3440 |
| 1055236 | N/A | N/A | 257663 | 257682 | AGGGAAATGGTCATTTTCTA | 87 | 3441 |
| 1055242 | N/A | N/A | 284227 | 284246 | GGGTTTTTCTGTACAAAGTT | 4 | 3442 |
| 1055247 | N/A | N/A | 284233 | 284252 | TTGTTTGGGTTTTCTGTAC | 3 | 3443 |
| 1055253 | N/A | N/A | 284331 | 284350 | TTCTTATCACTATTCAGTCA | 3 | 3444 |
| 1055259 | N/A | N/A | 284340 | 284359 | GTCAACTAGTTCTTATCACT | 2 | 3445 |
| 1055264 | N/A | N/A | 284347 | 284366 | AAACAATGTCAACTAGTTCT | 12 | 3446 |
| 1055270 | N/A | N/A | 291008 | 291027 | GTTTTTAGTTTTCCTTCTTG | 3 | 3447 |
| 1055275 | N/A | N/A | 291015 | 291034 | GTCCTGGGTTTTTAGTTTTC | 2 | 3448 |
| 1055281 | N/A | N/A | 291024 | 291043 | GAAGATTAGGTCCTGGGTTT | 5 | 3449 |
| 1055287 | N/A | N/A | 297003 | 297022 | TTGCATTAAATGACTGTGGT | 2 | 3450 |
| 1055292 | N/A | N/A | 297009 | 297028 | CAGTGTTTGCATTAAATGAC | 3 | 3451 |
| 1055298 | N/A | N/A | 306734 | 306753 | GGCCACTAAATCTGACCTTC | 54 | 3452 |
| 1055304 | N/A | N/A | 306748 | 306767 | AATCCATTGGTAAGGGCCAC | 4 | 3453 |
| 1055310 | N/A | N/A | 318484 | 318503 | GTTTGATATTTCTTTTTTTT | 2 | 3454 |
| 1055315 | N/A | N/A | 318491 | 318510 | CAAATGTGTTTGATATTTCT | 3 | 3455 |
| 1055321 | N/A | N/A | 332352 | 332371 | AACAATTTGCATAGTCTCTC | 3 | 3456 |
| 1055327 | N/A | N/A | 332361 | 332380 | GAGTATTATAACAATTTGCA | 3 | 3457 |
| 1055332 | N/A | N/A | 332368 | 332387 | TTCCAGGGAGTATTATAACA | 2 | 3458 |
| 1055338 | N/A | N/A | 347815 | 347834 | ATCTAGTTTCTGGAAAGTAA | 22 | 3459 |
| 1055349 | N/A | N/A | 347831 | 347850 | ATAACAAATGGTCATTATCT | 43 | 3460 |
| 1055355 | N/A | N/A | 365965 | 365984 | AATCCAAATCTTGTATTCTT | 9 | 3461 |
| 1055361 | N/A | N/A | 399995 | 400014 | TCTAGAAATGATTTTGATTA | 107 | 3462 |
| 1055366 | N/A | N/A | 439847 | 439866 | TGGGCATTTAAGAAATGCTC | 140 | 3463 |

TABLE 47

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 994448 | 5496 | 5515 | 459749 | 459768 | GTATTTGTTCAGTTTAGTTG | 9 | 352 |
| 994466 | 6034 | 6053 | 460287 | 460306 | GTGTTGGTTTAGTGGATCCA | 21 | 510 |
| 994571 | 10096 | 10115 | 464349 | 464368 | GGGTAATGATCTGATATTAA | 10 | 601 |
| 994598 | 201 | 220 | 9917 | 9936 | CTTGTAGTAGTTTTTGTGAG | 42 | 215 |
| 994605 | N/A | N/A | 17726 | 17745 | GTCACCTTTTCTATTTGCAC | 3 | 138 |
| 994702 | N/A | N/A | 210730 | 210749 | TGTGTAATACTCCATTTTTC | 8 | 228 |
| 994713 | N/A | N/A | 226996 | 227015 | TGGTTATTTACTCATTCTAC | 10 | 463 |
| 994732 | N/A | N/A | 284341 | 284360 | TGTCAACTAGTTCTTATCAC | 3 | 76 |
| 994743 | N/A | N/A | 318485 | 318504 | TGTTTGATATTTCTTTTTTT | 3 | 311 |
| 994756 | N/A | N/A | 332362 | 332381 | GGAGTATTATAACAATTTGC | 1 | 79 |
| 1040299 | 5502 | 5521 | 459755 | 459774 | AGTCAGGTATTTGTTCAGTT | 6 | 2809 |
| 1040631 | 10088 | 10107 | 464341 | 464360 | ATCTGATATTAAAACATCCA | 18 | 1280 |
| 1054949 | 109 | 128 | 2619 | 2638 | TGCGGCTGCTGTTGCTCTGG | 22 | 3464 |
| 1054954 | 115 | 134 | 2625 | 2644 | ATGTCTTGCGGCTGCTGTTG | 10 | 3465 |
| 1054965 | 247 | 266 | 10658 | 10677 | CTGGTGACTTGATGCACGAT | 21 | 3466 |
| 1054971 | 256 | 275 | 10667 | 10686 | TGGACCACCCTGGTGACTTG | 17 | 3467 |
| 1054977 | 560 | 579 | 178170 | 178189 | CATAAGCTATCAGTTCCTTG | 5 | 3468 |
| 1054982 | 566 | 585 | 178176 | 178195 | GAGAACCATAAGCTATCAGT | 11 | 3469 |
| 1054988 | 584 | 603 | 178194 | 178213 | TGTGCTTTCATCACAATGGA | 56 | 3470 |
| 1054993 | 591 | 610 | 178201 | 178220 | TGTACCATGTGCTTTCATCA | 3 | 3471 |
| 1054999 | 600 | 619 | N/A | N/A | TTGGAAAACTGTACCATGTG | 8 | 3472 |
| 1055013 | 6026 | 6045 | 460279 | 460298 | TTAGTGGATCCAGTCAATTC | 31 | 3473 |
| 1055022 | 6042 | 6061 | 460295 | 460314 | CCATCTTAGTGTTGGTTTAG | 23 | 3474 |
| 1055028 | 9483 | 9502 | 463736 | 463755 | TAGAGATTGTTGTTATTGTA | 14 | 3475 |
| 1055033 | 9489 | 9508 | 463742 | 463761 | AATTCTTAGAGATTGTTGTT | 19 | 3476 |
| 1055049 | 10104 | 10123 | 464357 | 464376 | CATATGGTGGGTAATGATCT | 62 | 3477 |
| 1055055 | 195 | 214 | 9911 | 9930 | GTAGTTTTGTGAGGTAAAA | 8 | 3478 |
| 1055063 | N/A | N/A | 17718 | 17737 | TTCTATTTGCACTAGCTGCC | 78 | 3479 |
| 1055069 | N/A | N/A | 17727 | 17746 | TGTCACCTTTTCTATTTGCA | 2 | 3480 |
| 1055075 | N/A | N/A | 17736 | 17755 | CCTCTCAAATGTCACCTTTT | 85 | 3481 |
| 1055081 | N/A | N/A | 85506 | 85525 | CTATGCTCACAGAGAACCTG | 98 | 3482 |
| 1055087 | N/A | N/A | 85515 | 85534 | TTTGATATGCTATGCTCACA | 13 | 3483 |
| 1055092 | N/A | N/A | 85522 | 85541 | CAGTTAGTTTGATATGCTAT | 25 | 3484 |
| 1055097 | N/A | N/A | 103952 | 103971 | TGTGATTTATCGCTGACCTT | 53 | 3485 |
| 1055103 | N/A | N/A | 148568 | 148587 | GAATGGTTCTCTTTTACGGG | 8 | 3486 |
| 1055109 | N/A | N/A | 179785 | 179804 | TATTTAATCATGTTCCCGAT | 19 | 3487 |

TABLE 47-continued

Reduction of ATXN1 RNA by 5-10-5 MOE
gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055114 | N/A | N/A | 179791 | 179810 | TAGTTATATTTAATCATGTT | 63 | 3488 |
| 1055119 | N/A | N/A | 184174 | 184193 | ATGTATACAATTCTGACAGT | 49 | 3489 |
| 1055125 | N/A | N/A | 184183 | 184202 | CAGGTTTATATGTATACAAT | 5 | 3490 |
| 1055130 | N/A | N/A | 184190 | 184209 | ATGTTCTCAGGTTTATATGT | 5 | 3491 |
| 1055136 | N/A | N/A | 203031 | 203050 | TTTCTTCTTTGTTCATAGGA | 71 | 3492 |
| 1055141 | N/A | N/A | 203038 | 203057 | TTGTTCCTTTCTTCTTTGTT | 46 | 3493 |
| 1055147 | N/A | N/A | 203047 | 203066 | AACAACCTCTTGTTCCTTTC | 13 | 3494 |
| 1055153 | N/A | N/A | 203891 | 203910 | TTGTTTAGATTTATCCTCAG | 6 | 3495 |
| 1055158 | N/A | N/A | 210722 | 210741 | ACTCCATTTTTCCTTCTAGA | 6 | 3496 |
| 1055169 | N/A | N/A | 210738 | 210757 | ATTACAAATGTGTAATACTC | 62 | 3497 |
| 1055175 | N/A | N/A | 212028 | 212047 | ATGTTAGTCATTTCTCTCTG | 20 | 3498 |
| 1055180 | N/A | N/A | 212034 | 212053 | AAGTCTATGTTAGTCATTTC | 31 | 3499 |
| 1055186 | N/A | N/A | 217274 | 217293 | AGGTATTTTCATGGAGTTTC | 3 | 3500 |
| 1055192 | N/A | N/A | 217283 | 217302 | TTATGTTTAAGGTATTTTCA | 60 | 3501 |
| 1055197 | N/A | N/A | 217290 | 217309 | GTAACAGTTATGTTTAAGGT | 8 | 3502 |
| 1055203 | N/A | N/A | 226988 | 227007 | TACTCATTCTACCTTCAACT | 72 | 3503 |
| 1055214 | N/A | N/A | 227004 | 227023 | CATAAACTTGGTTATTTACT | 65 | 3504 |
| 1055220 | N/A | N/A | 248565 | 248584 | CCACTACCACCCCCAAACCA | 53 | 3505 |
| 1055226 | N/A | N/A | 251502 | 251521 | CAGCATACTTAGCTTTTCAA | 16 | 3506 |
| 1055231 | N/A | N/A | 251508 | 251527 | CAGTGTCAGCATACTTAGCT | 20 | 3507 |
| 1055237 | N/A | N/A | 259737 | 259756 | CATGTATTGCTAGGAGCCAG | 46 | 3508 |
| 1055243 | N/A | N/A | 284228 | 284247 | TGGGTTTTTCTGTACAAAGT | 2 | 3509 |
| 1055248 | N/A | N/A | 284234 | 284253 | TTTGTTTGGGTTTTTCTGTA | 2 | 3510 |
| 1055254 | N/A | N/A | 284333 | 284352 | AGTTCTTATCACTATTCAGT | 2 | 3511 |
| 1055265 | N/A | N/A | 284349 | 284368 | CTAAACAATGTCAACTAGTT | 61 | 3512 |
| 1055271 | N/A | N/A | 291010 | 291029 | GGGTTTTTAGTTTTCCTTCT | 2 | 3513 |
| 1055276 | N/A | N/A | 291016 | 291035 | GGTCCTGGGTTTTTAGTTTT | 3 | 3514 |
| 1055282 | N/A | N/A | 296995 | 297014 | AATGACTGTGGTGCAGCCTC | 27 | 3515 |
| 1055288 | N/A | N/A | 297004 | 297023 | TTTGCATTAAATGACTGTGG | 2 | 3516 |
| 1055293 | N/A | N/A | 297011 | 297030 | GCCAGTGTTTGCATTAAATG | 2 | 3517 |
| 1055299 | N/A | N/A | 306736 | 306755 | AGGGCCACTAAATCTGACCT | 118 | 3518 |
| 1055305 | N/A | N/A | 306750 | 306769 | AGAATCCATTGGTAAGGGCC | 6 | 3519 |
| 1055316 | N/A | N/A | 318493 | 318512 | TTCAAATGTGTTTGATATTT | 12 | 3520 |
| 1055322 | N/A | N/A | 332354 | 332373 | ATAACAATTTGCATAGTCTC | 4 | 3521 |
| 1055333 | N/A | N/A | 332370 | 332389 | TTTTCCAGGGAGTATTATAA | 21 | 3522 |
| 1055339 | N/A | N/A | 347817 | 347836 | TTATCTAGTTTCTGGAAAGT | 39 | 3523 |

TABLE 47-continued

Reduction of ATXN1 RNA by 5-10-5 MOE gapmers with mixed PO/PS linkages in A-431 Cells

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN1 (% Control) | SEQ ID NO |
|---|---|---|---|---|---|---|---|
| 1055344 | N/A | N/A | 347824 | 347843 | ATGGTCATTATCTAGTTTCT | 2 | 3524 |
| 1055350 | N/A | N/A | 347833 | 347852 | TGATAACAAATGGTCATTAT | 32 | 3525 |
| 1055356 | N/A | N/A | 372672 | 372691 | CATCAAAATTGTGCACAATT | 81 | 3526 |
| 1055362 | N/A | N/A | 402059 | 402078 | TGAAAACATGTTGTGTGATT | 57 | 3527 |
| 1055367 | N/A | N/A | 453507 | 453526 | TTGTTGGATTCTTTTTTTCT | 27 | 3528 |

TABLE 48

Reduction of ATXN1 RNA by 5-10-5 MOE gapmers with mixed PO/PS linkages in A-431 Cells

| Compound Number | SEQ ID NO: 3 Start Site | SEQ ID NO: 3 Stop Site | Sequence (5' to 3') | ATXN1 (% Control) | SEQ ID NO |
|---|---|---|---|---|---|
| 1054961 | 193 | 212 | GACTTGATGCACGATGCTCT | 8 | 3529 |
| 1054958 | 187 | 206 | ATGCACGATGCTCTGTAAAG | 51 | 3530 |
| 1054959 | 189 | 208 | TGATGCACGATGCTCTGTAA | 42 | 3531 |
| 1054960 | 191 | 210 | CTTGATGCACGATGCTCTGT | 48 | 3532 |

Example 3: Effect of Modified Oligonucleotides on Human ATXN1 RNA In Vitro, Multiple Doses Modified oligonucleotides selected from the examples above were tested at various doses in A-431 cells. Cultured A-431 cells at a density of 10,000 cells per well were treated using free uptake with various concentrations of modified oligonucleotide as specified in the tables below. After a treatment period of approximately 48 hours, total RNA was isolated from the cells and ATXN1 RNA levels were measured by quantitative real-time RTPCR. Human ATXN1 primer probe set RTS37573 was used to measure RNA levels as described above. ATXN1 levels were adjusted according to total RNA content, as measured by RIBOGREEN® fluorescent RNA assay. Results are presented in the tables below as percent reduction of the amount of ATXN1 RNA, relative to untreated control. Where possible, the half maximal inhibitory concentration ($IC_{50}$) of each modified oligonucleotide was calculated using a linear regression on a log/linear plot of the data in excel.

TABLE 49

Dose-dependent percent reduction of human ATXN1 RNA in A-431 cells by modified oligonucleotides

| Compound No. | % Control 125 nM | 500 nM | 2000 nM | 8000 nM | IC50 (μM) |
|---|---|---|---|---|---|
| 994310 | 60 | 32 | 19 | 12 | 0.2 |
| 994316 | 36 | 15 | 9 | 9 | <0.1 |
| 994318 | 46 | 12 | 9 | 7 | <0.1 |
| 994319 | 31 | 13 | 8 | 7 | <0.1 |
| 994392 | 50 | 26 | 13 | 10 | <0.1 |
| 994421 | 16 | 8 | 8 | 10 | <0.1 |
| 994492 | 48 | 25 | 15 | 15 | <0.1 |
| 994542 | 55 | 36 | 25 | 22 | 0.1 |
| 994612 | 22 | 11 | 9 | 9 | <0.1 |
| 994613 | 30 | 23 | 15 | 14 | <0.1 |
| 994623 | 59 | 50 | 40 | 35 | 0.5 |
| 994628 | 21 | 9 | 7 | 9 | <0.1 |
| 994631 | 42 | 25 | 12 | 10 | <0.1 |
| 994645 | 90 | 78 | 68 | 56 | >8.0 |
| 994646 | 64 | 39 | 28 | 21 | 0.3 |
| 994652 | 24 | 11 | 9 | 9 | <0.1 |
| 994653 | 35 | 21 | 13 | 11 | <0.1 |
| 994812 | 31 | 13 | 9 | 8 | <0.1 |

TABLE 50

Dose-dependent percent reduction of human ATXN1 RNA in A-431 cells by modified oligonucleotides

| Compound No. | % Control 125 nM | 500 nM | 2000 nM | 8000 nM | IC50 (μM) |
|---|---|---|---|---|---|
| 994315 | 7 | 6 | 6 | 7 | <0.1 |
| 994320 | 11 | 7 | 4 | 5 | <0.1 |
| 994321 | 42 | 25 | 13 | 6 | <0.1 |
| 994395 | 41 | 27 | 21 | 12 | <0.1 |
| 994609 | 18 | 9 | 8 | 7 | <0.1 |
| 994610 | 94 | 95 | 79 | 63 | >8.0 |
| 994612 | 23 | 11 | 9 | 10 | <0.1 |
| 994616 | 70 | 51 | 40 | 27 | 0.7 |
| 994618 | 60 | 25 | 16 | 14 | 0.1 |
| 994619 | 53 | 32 | 18 | 10 | <0.1 |
| 994642 | 52 | 26 | 16 | 11 | <0.1 |
| 994643 | 56 | 35 | 23 | 17 | 0.2 |
| 994649 | 39 | 23 | 19 | 18 | <0.1 |
| 994651 | 21 | 9 | 7 | 6 | <0.1 |
| 994656 | 62 | 35 | 20 | 14 | 0.2 |
| 994696 | 34 | 17 | 12 | 9 | <0.1 |
| 994698 | 82 | 58 | 51 | 36 | 1.9 |
| 994770 | 46 | 23 | 12 | 11 | <0.1 |
| 994913 | 48 | 30 | 18 | 12 | <0.1 |

TABLE 51

Dose-dependent percent reduction of human ATXN1 RNA by modified oligonucleotides

| Compound No. | % Control 125 nM | % Control 500 nM | % Control 2000 nM | % Control 8000 nM | IC50 (μM) |
|---|---|---|---|---|---|
| 994328 | 115 | 120 | 134 | 116 | >8.0 |
| 994597 | 57 | 24 | 11 | 10 | <0.1 |
| 994599 | 55 | 36 | 30 | 22 | 0.1 |
| 994612 | 28 | 12 | 8 | 12 | <0.1 |
| 994630 | 68 | 43 | 26 | 15 | 0.4 |
| 994638 | 76 | 40 | 22 | 15 | 0.4 |
| 994693 | 78 | 55 | 35 | 17 | 0.8 |
| 994700 | 12 | 5 | 4 | 4 | <0.1 |
| 994701 | 63 | 36 | 19 | 16 | 0.2 |
| 994702 | 50 | 27 | 16 | 12 | <0.1 |
| 994703 | 66 | 43 | 29 | 16 | 0.4 |
| 994717 | 11 | 8 | 9 | 6 | <0.1 |
| 994732 | 21 | 11 | 9 | 9 | <0.1 |
| 994734 | 9 | 4 | 2 | 2 | <0.1 |
| 994735 | 49 | 21 | 15 | 14 | <0.1 |
| 994740 | 67 | 37 | 20 | 15 | 0.3 |
| 994743 | 23 | 11 | 9 | 11 | <0.1 |
| 994756 | 39 | 21 | 13 | 12 | <0.1 |
| 994918 | 63 | 41 | 24 | 15 | 0.3 |

TABLE 52

Dose-dependent percent reduction of human ATXN1 RNA by modified oligonucleotides

| Compound No. | % Control 125 nM | % Control 500 nM | % Control 2000 nM | % Control 8000 nM | IC50 (μM) |
|---|---|---|---|---|---|
| 994313 | 63 | 31 | 15 | 9 | 0.2 |
| 994314 | 41 | 19 | 10 | 15 | <0.1 |
| 994329 | 18 | 7 | 5 | 5 | <0.1 |
| 994346 | 17 | 8 | 6 | 8 | <0.1 |
| 994449 | 28 | 9 | 8 | 10 | <0.1 |
| 994466 | 103 | 104 | 79 | 79 | >8.0 |
| 994474 | 36 | 14 | 13 | 11 | <0.1 |
| 994497 | 16 | 9 | 9 | 10 | <0.1 |
| 994561 | 34 | 17 | 12 | 10 | <0.1 |
| 994571 | 95 | 77 | 76 | 73 | >8.0 |
| 994612 | 26 | 12 | 10 | 9 | <0.1 |
| 994690 | 87 | 60 | 42 | 40 | 1.9 |
| 994697 | 23 | 10 | 6 | 5 | <0.1 |
| 994706 | 12 | 7 | 5 | 5 | <0.1 |
| 994713 | 79 | 61 | 24 | 11 | 0.7 |
| 994731 | 65 | 31 | 18 | 16 | 0.2 |
| 994761 | 57 | 25 | 14 | 14 | <0.1 |
| 994835 | 75 | 36 | 21 | 19 | 0.4 |
| 994848 | 61 | 33 | 22 | 16 | 0.2 |

Example 4: Design of Modified Oligonucleotides Complementary to a Human ATXN1 Nucleic Acid Modified oligonucleotides were designed and synthesized as indicated in the tables below.

The compounds in table 53 are 5-10-5 MOE gapmers with mixed internucleoside linkages. The gapmers are 20 nucleosides in length, wherein the central gap segment consists of ten 2'-β-D-deoxynucleosides, the 5' wing segment consists of five 2'-MOE nucleosides, and the 3' wing segment consists of five 2'-MOE nucleosides. The sugar motif of the gapmers is (from 5' to 3'): eeeeedddddddddddeeeee; wherein 'd' represents a 2'-β-D-deoxyribosyl sugar moiety, and 'e' represents a 2'-MOE sugar moiety. The gapmers have an internucleoside linkage motif of (from 5' to 3'): sooosssssssssssooss; wherein "s" represents a phosphorothioate internucleoside linkage and "o" represents a phosphodiester internucleoside linkage. All cytosine residues are 5-methylcytosines.

TABLE 53

5-10-5 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1342029 | TGATTGTGTTCCATTGTAAA | 7023 | 7042 | 461276 | 461295 | 3533 |
| 1342030 | GAGTTGTCCATAGTCATGAA | 4432 | 4451 | 458685 | 458704 | 3534 |
| 1342031 | CGAGTTGTCCATAGTCATGA | 4433 | 4452 | 458686 | 458705 | 3535 |
| 1342033 | TGCACTTTTGTTTCTACAGC | N/A | N/A | 441087 | 441106 | 3536 |
| 1342034 | AGGCCTTGCACTTTTGTTTC | N/A | N/A | 441093 | 441112 | 3537 |
| 1342035 | AAGTGGCACCCGAGTTGTCC | 4443 | 4462 | 458696 | 458715 | 3538 |
| 1342036 | GCCTTGCACTTTTGTTTCTA | N/A | N/A | 441091 | 441110 | 3539 |
| 1342037 | GATTGTGTTCCATTGTAAAC | 7022 | 7041 | 461275 | 461294 | 3540 |
| 1342039 | GTGGATCCAGTCAATTCAAT | 6023 | 6042 | 460276 | 460295 | 3541 |
| 1342040 | AATAGCAGCTATTTCATGAC | N/A | N/A | 439446 | 439465 | 3542 |
| 1342044 | TGGATCCAGTCAATTCAATA | 6022 | 6041 | 460275 | 460294 | 3543 |

TABLE 53-continued 5-10-5 MOE gapmers with mixed PO/PS internucleoside
linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1342045 | TCAATTCAATACTCGAAGTA | 6013 | 6032 | 460266 | 460285 | 3544 |
| 1342046 | GGATCCAGTCAATTCAATAC | 6021 | 6040 | 460274 | 460293 | 3545 |
| 1342050 | CAATGACTCTTCACTCATGT | N/A | N/A | 440235 | 440254 | 3546 |
| 1342051 | ACTATTTTCAACTCAAGCTG | N/A | N/A | 439428 | 439447 | 3547 |
| 1342052 | GACTCTTCACTCATGTTTAT | N/A | N/A | 440231 | 440250 | 3548 |
| 1342053 | GGTACTGGCTCATCAGTTGT | N/A | N/A | 444368 | 444387 | 3549 |
| 1342054 | AATGACTCTTCACTCATGTT | N/A | N/A | 440234 | 440253 | 3550 |
| 1342055 | AGCAATGACTCTTCACTCAT | N/A | N/A | 440237 | 440256 | 3551 |
| 1342057 | AAGCAATGACTCTTCACTCA | N/A | N/A | 440238 | 440257 | 3552 |
| 1342060 | AACCAATCTATCACACCAAT | N/A | N/A | 444348 | 444367 | 3553 |
| 1342063 | AGCCATCCAAGTAAGAATAT | 5475 | 5494 | 459728 | 459747 | 3554 |
| 1342065 | ACCAATCTATCACACCAATG | N/A | N/A | 444347 | 444366 | 3555 |
| 1342066 | CAATCTATCACACCAATGCA | N/A | N/A | 444345 | 444364 | 3556 |
| 1342068 | CAGCCATCCAAGTAAGAATA | 5476 | 5495 | 459729 | 459748 | 3557 |
| 1342069 | TATTGTCACATACTAGTTCA | 4755 | 4774 | 459008 | 459027 | 3558 |
| 1342070 | CTGACTAATTTCTTGGTGAT | 7039 | 7058 | 461292 | 461311 | 3559 |
| 1342074 | GTGGTCATTTATTGTCACAT | 4764 | 4783 | 459017 | 459036 | 3560 |
| 1342075 | GTCACATACTAGTTCATAAT | 4751 | 4770 | 459004 | 459023 | 3561 |
| 1342076 | TTATTGTCACATACTAGTTC | 4756 | 4775 | 459009 | 459028 | 3562 |
| 1342032 | CCCGAGTTGTCCATAGTCAT | 4435 | 4454 | 458688 | 458707 | 3563 |
| 1342038 | CATTGTAAACGCAAAAGGCC | 7012 | 7031 | 461265 | 461284 | 3564 |
| 1342041 | CAGTCAATTCAATACTCGAA | 6016 | 6035 | 460269 | 460288 | 3565 |
| 1342042 | GTCCATAGTCATGAACTATA | 4427 | 4446 | 458680 | 458699 | 3566 |
| 1342043 | ATAGCAGCTATTTCATGACT | N/A | N/A | 439445 | 439464 | 3567 |
| 1342047 | GTCAATTCAATACTCGAAGT | 6014 | 6033 | 460267 | 460286 | 3568 |
| 1342048 | GATCCAGTCAATTCAATACT | 6020 | 6039 | 460273 | 460292 | 3569 |
| 1342049 | TAACCAATCTATCACACCAA | N/A | N/A | 444349 | 444368 | 3570 |
| 1342056 | ATGACTCTTCACTCATGTTT | N/A | N/A | 440233 | 440252 | 3571 |
| 1342058 | GACTATTTCAACTCAAGCT | N/A | N/A | 439429 | 439448 | 3572 |
| 1342059 | CTTGGTGGTCATTTATTGTC | 4768 | 4787 | 459021 | 459040 | 3573 |
| 1342061 | GGTGGTCATTTATTGTCACA | 4765 | 4784 | 459018 | 459037 | 3574 |
| 1342062 | TAGTTGCAGCCATCCAAGTA | 5482 | 5501 | 459735 | 459754 | 3575 |
| 1342064 | TGGTGGTCATTTATTGTCAC | 4766 | 4785 | 459019 | 459038 | 3576 |
| 1342067 | GTTCAGTTAGTTGCAGCCA | 5490 | 5509 | 459743 | 459762 | 3577 |
| 1342071 | CATACTAGTTCATAATTCAC | 4747 | 4766 | 459000 | 459019 | 3578 |

TABLE 53-continued 5-10-5 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1342072 | TCGCCCTGACTAATTTCTTG | 7044 | 7063 | 461297 | 461316 | 3579 |
| 1342073 | CCCTGACTAATTTCTTGGTG | 7041 | 7060 | 461294 | 461313 | 3580 |
| 1342077 | GCCCTGACTAATTTCTTGGT | 7042 | 7061 | 461295 | 461314 | 3581 |

The compounds in table 54 are 5-10-5 MOE gapmers with mixed internucleoside linkages. The gapmers are 20 nucleosides in length, wherein the central gap segment consists of ten 2'-β-D-deoxynucleosides, the 5' wing segment consists of five 2'-MOE nucleosides, and the 3' wing segment consists of five 2'-MOE nucleosides. The sugar motif of the gapmers is (from 5' to 3'): eeeeedddddddddeeeee; wherein 'd' represents a 2'-β-D-deoxyribosyl sugar moiety, and 'e' represents a 2'-MOE sugar moiety. The gapmers have an internucleoside linkage motif of (from 5' to 3'): sssosssssssssssosss; wherein "s" represents a phosphorothioate internucleoside linkage and "o" represents a phosphodiester internucleoside linkage. All cytosine residues are 5-methylcytosines.

TABLE 54

5-10-5 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1364280 | ACCCGAGTTGTCCATAGTCA | 4436 | 4455 | 458689 | 458708 | 582 |
| 1364281 | CCACGCTTTTATTTTCTGAT | N/A | N/A | 439093 | 439112 | 2074 |
| 1364282 | GCCTTTATAACTTTTCTTTC | N/A | N/A | 446680 | 446699 | 2552 |
| 1364283 | GGTCATTTATTGTCACATAC | 4762 | 4781 | 459015 | 459034 | 194 |
| 1364285 | ATTTTCTTTTTTCTGTGCCT | N/A | N/A | 452653 | 452672 | 488 |
| 1367569 | TTCCTCTTACCATCAAAGGC | 5906 | 5925 | 460159 | 460178 | 2502 |
| 1367572 | CGTGGGTGTTCGCTCTCTCC | 4256 | 4275 | 458509 | 458528 | 3582 |
| 1367573 | GCGTGGGTGTTCGCTCTCTC | 4257 | 4276 | 458510 | 458529 | 3583 |
| 1367575 | CTCTTACCATCAAAGGCTAA | 5903 | 5922 | 460156 | 460175 | 3584 |
| 1367576 | CCTCTTACCATCAAAGGCTA | 5904 | 5923 | 460157 | 460176 | 2425 |
| 1367577 | TCCTCTTACCATCAAAGGCT | 5905 | 5924 | 460158 | 460177 | 431 |
| 1367580 | CAGCCCGTATTCCTCTTACC | 5915 | 5934 | 460168 | 460187 | 509 |
| 1367581 | TGTGGCAGCCCGTATTCCTC | 5920 | 5939 | 460173 | 460192 | 3585 |
| 1367586 | GGGTGTTCGCTCTCTCCCTC | 4253 | 4272 | 458506 | 458525 | 3586 |
| 1367588 | GTGGGTGTTCGCTCTCTCCC | 4255 | 4274 | 458508 | 458527 | 3587 |
| 1367589 | CCGTATTCCTCTTACCATCA | 5911 | 5930 | 460164 | 460183 | 3588 |
| 1367590 | GTATTCCTCTTACCATCAAA | 5909 | 5928 | 460162 | 460181 | 3589 |
| 1367591 | CCCGTATTCCTCTTACCATC | 5912 | 5931 | 460165 | 460184 | 3590 |
| 1394153 | CCCGAGTTGTCCATAGTCAT | 4435 | 4454 | 458688 | 458707 | 3563 |
| 1394154 | GCACCCGAGTTGTCCATAGT | 4438 | 4457 | 458691 | 458710 | 3605 |
| 1394155 | CACCCGAGTTGTCCATAGTC | 4437 | 4456 | 458690 | 458709 | 3593 |
| 1394156 | GTCAGGTATTTGTTCAGTTT | 5501 | 5520 | 459754 | 459773 | 3402 |
| 1394157 | TGTTCAGTTTAGTTGCAGCC | 5491 | 5510 | 459744 | 459763 | 274 |

TABLE 54-continued 5-10-5 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1394158 | TTGTTCAGTTTAGTTGCAGC | 5492 | 5511 | 459745 | 459764 | 3655 |
| 1394159 | GTTCAGTTTAGTTGCAGCCA | 5490 | 5509 | 459743 | 459762 | 3577 |
| 1394160 | TCAGGTATTTGTTCAGTTTA | 5500 | 5519 | 459753 | 459772 | 3331 |
| 1394161 | GCCCGTATTCCTCTTACCAT | 5913 | 5932 | 460166 | 460185 | 2579 |
| 1394507 | GGTGGTCATTTATTGTCACA | 4765 | 4784 | 459018 | 459037 | 3574 |
| 1394508 | GTGATTGTGTTCCATTGTAA | 7024 | 7043 | 461277 | 461296 | 201 |
| 1394510 | CCTTGCACTTTTGTTTCTAC | N/A | N/A | 441090 | 441109 | 321 |
| 1394511 | GTGGTCATTTATTGTCACAT | 4764 | 4783 | 459017 | 459036 | 3560 |
| 1394512 | ATGTGTTCTTAAATTCTCTA | 8210 | 8229 | 462463 | 462482 | 1583 |
| 1394513 | GCACGGTATTAGTGTCTTCA | 7892 | 7911 | 462145 | 462164 | 126 |
| 1394514 | GCTTCTCAAATCAGGTGTAC | 8481 | 8500 | 462734 | 462753 | 1045 |
| 1394515 | TGATTGTGTTCCATTGTAAA | 7023 | 7042 | 461276 | 461295 | 3533 |
| 1394516 | GTTTGTTGGTTTCTTATTAA | 7083 | 7102 | 461336 | 461355 | 46 |
| 1394517 | CTGTATATTTATTACTTGAT | 8228 | 8247 | 462481 | 462500 | 1891 |
| 1394518 | TGGTCATTTATTGTCACATA | 4763 | 4782 | 459016 | 459035 | 3038 |

The compounds in table 55 are 6-10-4 MOE gapmers with mixed internucleoside linkages. The gapmers are 20 nucleosides in length, wherein the central gap segment consists of ten 2'-β-D-deoxynucleosides, the 5' wing segment consists of six 2'-MOE nucleosides, and the 3' wing segment consists of four 2'-MOE nucleosides. The sugar motif of the gapmers is (from 5' to 3'): eeeeeedddddddddddeeee; wherein 'd' represents a 2'-β-D-deoxyribosyl sugar moiety, and 'e' represents a 2'-MOE sugar moiety. The gapmers have an internucleoside linkage motif of (from 5' to 3'): sooooossssssssssoss; wherein "s" represents a phosphorothioate internucleoside linkage and "o" represents a phosphodiester internucleoside linkage. All cytosine residues are 5-methylcytosines.

TABLE 55

6-10-4 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1371806 | GTTCGCTCTCTCCCTCTCCC | 4249 | 4268 | 458502 | 458521 | 114 |
| 1371807 | TTTTCTTTTCGCCCTGACTA | 7052 | 7071 | 461305 | 461324 | 3591 |
| 1371808 | TCATTTATTGTCACATACTA | 4760 | 4779 | 459013 | 459032 | 3592 |
| 1371809 | CACCCGAGTTGTCCATAGTC | 4437 | 4456 | 458690 | 458709 | 3593 |
| 1371810 | GTCATTTATTGTCACATACT | 4761 | 4780 | 459014 | 459033 | 3594 |
| 1371811 | TTTTTTCTTTTCGCCCTGAC | 7054 | 7073 | 461307 | 461326 | 3595 |
| 1371812 | GTTGTCCATAGTCATGAACT | 4430 | 4449 | 458683 | 458702 | 3596 |
| 1371813 | TAATTCACATTCATCCCTTT | 4735 | 4754 | 458988 | 459007 | 3597 |
| 1371814 | CCCTGACTAATTTCTTGGTG | 7041 | 7060 | 461294 | 461313 | 3580 |
| 1371815 | ATAATTCACATTCATCCCTT | 4736 | 4755 | 458989 | 459008 | 2268 |

TABLE 55-continued 6-10-4 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1371816 | TGGTCATTTATTGTCACATA | 4763 | 4782 | 459016 | 459035 | 3038 |
| 1371817 | TTGTCCATAGTCATGAACTA | 4429 | 4448 | 458682 | 458701 | 2421 |
| 1371818 | AGTTGCAGCCATCCAAGTAA | 5481 | 5500 | 459734 | 459753 | 2655 |
| 1371819 | GTTCATAATTCACATTCATC | 4740 | 4759 | 458993 | 459012 | 2499 |
| 1371820 | GCCCCCAAACCCATTTTCTT | N/A | N/A | 452665 | 452684 | 1026 |
| 1371821 | CAGCCATCCAAGTAAGAATA | 5476 | 5495 | 459729 | 459748 | 3557 |
| 1371822 | TTCATAATTCACATTCATCC | 4739 | 4758 | 458992 | 459011 | 2422 |
| 1371823 | GAGAACAAAGTCTATGTGGC | 5934 | 5953 | 460187 | 460206 | 2733 |
| 1371824 | CCCGAGTTGTCCATAGTCAT | 4435 | 4454 | 458688 | 458707 | 3563 |
| 1371825 | AGCCCGTATTCCTCTTACCA | 5914 | 5933 | 460167 | 460186 | 2656 |
| 1371826 | TCCTAACACTGCACAGAAAC | 4279 | 4298 | 458532 | 458551 | 3598 |
| 1371827 | TCAGGTATTTGTTCAGTTTA | 5500 | 5519 | 459753 | 459772 | 3331 |
| 1371828 | TCCATAGTCATGAACTATAA | 4426 | 4445 | 458679 | 458698 | 3599 |
| 1371829 | GTCAGGTATTTGTTCAGTTT | 5501 | 5520 | 459754 | 459773 | 3402 |
| 1371830 | GTGATTGTGTTCCATTGTAA | 7024 | 7043 | 461277 | 461296 | 201 |
| 1371831 | CCATAGTCATGAACTATAAA | 4425 | 4444 | 458678 | 458697 | 3600 |
| 1371832 | TTTTTCTGTGCCTCCTGACC | N/A | N/A | 452646 | 452665 | 795 |
| 1371833 | TGATTGTGTTCCATTGTAAA | 7023 | 7042 | 461276 | 461295 | 3533 |
| 1371834 | CCTGACTAATTTCTTGGTGA | 7040 | 7059 | 461293 | 461312 | 2350 |
| 1371835 | CATAGTCATGAACTATAAAC | 4424 | 4443 | 458677 | 458696 | 3601 |
| 1371836 | GAGTTGTCCATAGTCATGAA | 4432 | 4451 | 458685 | 458704 | 3534 |
| 1371837 | AAAGAAAAGTCAGGTATTTG | 5509 | 5528 | 459762 | 459781 | 3332 |
| 1371838 | GCCCTGACTAATTTCTTGGT | 7042 | 7061 | 461295 | 461314 | 3581 |
| 1371839 | ACAGAAACCAGCGTGGGTGT | 4267 | 4286 | 458520 | 458539 | 3602 |
| 1371840 | CTGACTAATTTCTTGGTGAT | 7039 | 7058 | 461292 | 461311 | 3559 |
| 1371841 | CCTCTTACCATCAAAGGCTA | 5904 | 5923 | 460157 | 460176 | 2425 |
| 1371842 | GCCCGTATTCCTCTTACCAT | 5913 | 5932 | 460166 | 460185 | 2579 |
| 1371843 | GCAGCCATCCAAGTAAGAAT | 5477 | 5496 | 459730 | 459749 | 2578 |
| 1371844 | TCATAATTCACATTCATCCC | 4738 | 4757 | 458991 | 459010 | 2345 |
| 1371845 | AGTTCATAATTCACATTCAT | 4741 | 4760 | 458994 | 459013 | 2576 |
| 1371846 | GTGTTCCATTGTAAACGCAA | 7018 | 7037 | 461271 | 461290 | 123 |
| 1371847 | ATTTTCTTTTTCTGTGCCT | N/A | N/A | 452653 | 452672 | 488 |
| 1371848 | GGTCATTTATTGTCACATAC | 4762 | 4781 | 459015 | 459034 | 194 |
| 1371849 | TCCTCTTACCATCAAAGGCT | 5905 | 5924 | 460158 | 460177 | 431 |
| 1371850 | TGGGTGTTCGCTCTCTCCCT | 4254 | 4273 | 458507 | 458526 | 270 |
| 1371851 | ACCCGAGTTGTCCATAGTCA | 4436 | 4455 | 458689 | 458708 | 582 |

TABLE 55-continued 6-10-4 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1371852 | CTGCACAGAAACCAGCGTGG | 4271 | 4290 | 458524 | 458543 | 3603 |
| 1371853 | CATAATTCACATTCATCCCT | 4737 | 4756 | 458990 | 459009 | 3604 |
| 1371854 | GCACCCGAGTTGTCCATAGT | 4438 | 4457 | 458691 | 458710 | 3605 |
| 1371855 | TTTTTCTTTTCGCCCTGACT | 7053 | 7072 | 461306 | 461325 | 3606 |
| 1371856 | ACTGCACAGAAACCAGCGTG | 4272 | 4291 | 458525 | 458544 | 3607 |
| 1371857 | TGTGTTCCATTGTAAACGCA | 7019 | 7038 | 461272 | 461291 | 3608 |
| 1371858 | CCTAACACTGCACAGAAACC | 4278 | 4297 | 458531 | 458550 | 3609 |
| 1371859 | TTTTATCCCAGTCATTGGCC | N/A | N/A | 452682 | 452701 | 3610 |
| 1371860 | CCAGTCATTGGCCCCCAAAC | N/A | N/A | 452675 | 452694 | 3611 |
| 1371861 | GGGTGTTCGCTCTCTCCCTC | 4253 | 4272 | 458506 | 458525 | 3586 |
| 1371862 | TTTTCTGTGCCTCCTGACCT | N/A | N/A | 452645 | 452664 | 3612 |
| 1371863 | GACCTCTACCCTTGTGAGCA | N/A | N/A | 452630 | 452649 | 3613 |
| 1371864 | CACTGCACAGAAACCAGCGT | 4273 | 4292 | 458526 | 458545 | 3614 |
| 1371865 | TTAATGAGAACAAAGTCTAT | 5939 | 5958 | 460192 | 460211 | 3615 |
| 1371866 | CATCCAAGTAAGAATATTTA | 5472 | 5491 | 459725 | 459744 | 3616 |
| 1371867 | AACACTGCACAGAAACCAGC | 4275 | 4294 | 458528 | 458547 | 3617 |
| 1371868 | AATGAGAACAAAGTCTATGT | 5937 | 5956 | 460190 | 460209 | 3618 |
| 1371869 | GCCATCCAAGTAAGAATATT | 5474 | 5493 | 459727 | 459746 | 3619 |
| 1371870 | TGTGGCAGCCCGTATTCCTC | 5920 | 5939 | 460173 | 460192 | 3585 |
| 1371871 | GTTGCAGCCATCCAAGTAAG | 5480 | 5499 | 459733 | 459752 | 3620 |
| 1371872 | CCGAGTTGTCCATAGTCATG | 4434 | 4453 | 458687 | 458706 | 3621 |
| 1371873 | CAAAGTCTATGTGGCAGCCC | 5929 | 5948 | 460182 | 460201 | 3622 |
| 1371874 | TAACACTGCACAGAAACCAG | 4276 | 4295 | 458529 | 458548 | 3623 |
| 1371875 | CCCGTATTCCTCTTACCATC | 5912 | 5931 | 460165 | 460184 | 3590 |
| 1371876 | CAGTTTAGTTGCAGCCATCC | 5487 | 5506 | 459740 | 459759 | 3624 |
| 1371877 | GTATTCCTCTTACCATCAAA | 5909 | 5928 | 460162 | 460181 | 3589 |
| 1394164 | TGTTCAGTTTAGTTGCAGCC | 5491 | 5510 | 459744 | 459763 | 274 |
| 1394165 | CCGTATTCCTCTTACCATCA | 5911 | 5930 | 460164 | 460183 | 3588 |
| 1394166 | TTCAGTTTAGTTGCAGCCAT | 5489 | 5508 | 459742 | 459761 | 3190 |
| 1394167 | TTGTTCAGTTTAGTTGCAGC | 5492 | 5511 | 459745 | 459764 | 3655 |
| 1394168 | GTTCAGTTTAGTTGCAGCCA | 5490 | 5509 | 459743 | 459762 | 3577 |
| 1394522 | GCCTTTATAACTTTTCTTTC | N/A | N/A | 446680 | 446699 | 2552 |
| 1394523 | GGTGGTCATTTATTGTCACA | 4765 | 4784 | 459018 | 459037 | 3574 |
| 1394524 | CAGCCCGTATTCCTCTTACC | 5915 | 5934 | 460168 | 460187 | 509 |
| 1394525 | GCTTCTCAAATCAGGTGTAC | 8481 | 8500 | 462734 | 462753 | 1045 |
| 1394526 | CCACGCTTTTATTTTCTGAT | N/A | N/A | 439093 | 439112 | 2074 |

TABLE 55-continued 6-10-4 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1394527 | GTGGTCATTTATTGTCACAT | 4764 | 4783 | 459017 | 459036 | 3560 |
| 1394528 | ATGTGTTCTTAAATTCTCTA | 8210 | 8229 | 462463 | 462482 | 1583 |
| 1394529 | GCACGGTATTAGTGTCTTCA | 7892 | 7911 | 462145 | 462164 | 126 |
| 1394530 | GTTTGTTGGTTTCTTATTAA | 7083 | 7102 | 461336 | 461355 | 46 |
| 1394531 | CTGTATATTTATTACTTGAT | 8228 | 8247 | 462481 | 462500 | 1891 |
| 1394532 | CCTTGCACTTTTGTTTCTAC | N/A | N/A | 441090 | 441109 | 321 |

The compounds in table 56 are 5-8-4 mixed MOE/cEt gapmers with mixed internucleoside linkages. The gapmers are 17 nucleosides in length, wherein the central gap segment consists of eight 2'-β-D-deoxynucleosides, the 5' wing segment consists of five 2'-MOE nucleosides, and the 3' wing segment consists of two cEt nucleosides and two 2'-MOE nucleosides. The sugar motif of the gapmers is (from 5' to 3'): eeeeeddddddddkkee; wherein 'd' represents a 2'-β-D-deoxyribosyl sugar moiety, 'k' represents a cEt sugar moiety, and 'e' represents a 2'-MOE sugar moiety. The gapmers have an internucleoside linkage motif of (from 5' to 3'): sssosssssssssoss; wherein "s" represents a phosphorothioate internucleoside linkage and "o" represents a phosphodiester internucleoside linkage. All cytosine residues are 5-methylcytosines.

TABLE 56

5-8-4 MOE/cEt mixed wing gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1365254 | CACGCTTTTATTTTCTG | N/A | N/A | 439095 | 439111 | 3625 |
| 1365255 | CCACGCTTTTATTTTCT | N/A | N/A | 439096 | 439112 | 3626 |
| 1365258 | TTTATAACTTTTCTTTC | N/A | N/A | 446680 | 446696 | 3627 |
| 1365259 | CTTTATAACTTTTCTTT | N/A | N/A | 446681 | 446697 | 3628 |
| 1365260 | CCTTTATAACTTTTCTT | N/A | N/A | 446682 | 446698 | 3629 |
| 1365261 | GCCTTTATAACTTTTCT | N/A | N/A | 446683 | 446699 | 3630 |
| 1365262 | TCATTTATTGTCACATA | 4763 | 4779 | 459016 | 459032 | 3631 |
| 1365263 | CATTTATTGTCACATAC | 4762 | 4778 | 459015 | 459031 | 3632 |
| 1365264 | GTCATTTATTGTCACAT | 4764 | 4780 | 459017 | 459033 | 3633 |
| 1365265 | GGTCATTTATTGTCACA | 4765 | 4781 | 459018 | 459034 | 3634 |
| 1365267 | CCGAGTTGTCCATAGTC | 4437 | 4453 | 458690 | 458706 | 3635 |
| 1365268 | CCCGAGTTGTCCATAGT | 4438 | 4454 | 458691 | 458707 | 3636 |
| 1365270 | ACCCGAGTTGTCCATAG | 4439 | 4455 | 458692 | 458708 | 3637 |
| 1365271 | TCAGTTTAGTTGCAGCC | 5491 | 5507 | 459744 | 459760 | 3638 |
| 1365272 | CAGTTTAGTTGCAGCCA | 5490 | 5506 | 459743 | 459759 | 3639 |
| 1365274 | TTCAGTTTAGTTGCAGC | 5492 | 5508 | 459745 | 459761 | 3640 |
| 1365275 | TTCTTTTTTCTGTGCCT | N/A | N/A | 452653 | 452669 | 3641 |

The compounds in table 57 are 5-8-4 mixed gapmers with mixed internucleoside linkages. The mixed gapmers have mixed cEt/MOE wings and a 2'-OMe modified nucleoside at position 2 of the gap. The gapmers are 17 nucleosides in length, wherein the 5' wing segment consists of five 2'-MOE nucleosides, the 3' wing segment consists of two cEt nucleosides and two 2'-MOE nucleosides. The gap is eight nucleosides in length, and has a nucleoside comprising a 2'-β-D-deoxyribosyl sugar moiety at positions 1, 3, 4, 5, 6, 7, and 8 of the gap (counting from the 5' end) and 2'-OMe nucleoside at position 2 of the gap (counting from the 5' end). The sugar motif of the mixed gapmers is (from 5' to 3'): eeeeedydddddkkee; wherein 'd' represents a 2'-β-D-deoxyribosyl sugar moiety, 'y' represents a 2'-O-methyl ribose sugar moiety, 'k' represents a cEt sugar moiety, and 'e' represents a 2'-MOE sugar moiety. The gapmers have an internucleoside linkage motif of (from 5' to 3'): sssosssssss-soss; wherein "s" represents a phosphorothioate internucleoside linkage and "o" represents a phosphodiester internucleoside linkage. All cytosine residues are 5-methylcytosines.

The compounds in table 58 are 5-8-4 MOE gapmers with mixed internucleoside linkages. The gapmers are 17 nucleosides in length, wherein the central gap segment consists of eight 2'-β-D-deoxynucleosides, the 5' wing segment consists of five 2'-MOE nucleosides, and the 3' wing segment consists of four 2'-MOE nucleosides. The sugar motif of the gapmers is (from 5' to 3'): eeeeedddddddeeee; wherein 'd' represents a 2'-β-D-deoxyribosyl sugar moiety, and 'e' represents a 2'-MOE sugar moiety. The gapmers have an internucleoside linkage motif of (from 5' to 3'): sssosssssss-soss; wherein "s" represents a phosphorothioate internucleoside linkage and "o" represents a phosphodiester internucleoside linkage. All cytosine residues are 5-methylcytosines.

TABLE 57

5-8-4 MOE/cEt mixed gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1365278 | CGCTTTUATTTTCTGAT | N/A | N/A | 439093 | 439109 | 3642 |
| 1365281 | CCACGCUTTTATTTTCT | N/A | N/A | 439096 | 439112 | 3643 |
| 1365282 | TTTATAACTTTTCTTTC | N/A | N/A | 446680 | 446696 | 3627 |
| 1365283 | CCTTTAUAACTTTTCTT | N/A | N/A | 446682 | 446698 | 3644 |
| 1365284 | GCCTTTATAACTTTTCT | N/A | N/A | 446683 | 446699 | 3630 |
| 1365285 | CATTTAUTGTCACATAC | 4762 | 4778 | 459015 | 459031 | 3645 |
| 1365286 | TCATTTATTGTCACATA | 4763 | 4779 | 459016 | 459032 | 3631 |
| 1365287 | CTTTATAACTTTTCTTT | N/A | N/A | 446681 | 446697 | 3628 |
| 1365288 | GTCATTUATTGTCACAT | 4764 | 4780 | 459017 | 459033 | 3646 |
| 1365289 | GGTCATUTATTGTCACA | 4765 | 4781 | 459018 | 459034 | 3647 |
| 1365290 | CCGAGTUGTCCATAGTC | 4437 | 4453 | 458690 | 458706 | 3648 |
| 1365291 | CGAGTTGTCCATAGTCA | 4436 | 4452 | 458689 | 458705 | 3649 |
| 1365292 | ACCCGAGTTGTCCATAG | 4439 | 4455 | 458692 | 458708 | 3637 |
| 1365293 | TTTCTTUTTTCTGTGCC | N/A | N/A | 452654 | 452670 | 3650 |
| 1365294 | CAGTTTAGTTGCAGCCA | 5490 | 5506 | 459743 | 459759 | 3639 |
| 1365297 | TTCTTTUTTCTGTGCCT | N/A | N/A | 452653 | 452669 | 3651 |
| 1365298 | CCCGAGUTGTCCATAGT | 4438 | 4454 | 458691 | 458707 | 3652 |
| 1365299 | TTCAGTUTAGTTGCAGC | 5492 | 5508 | 459745 | 459761 | 3653 |
| 1365300 | TCAGTTUAGTTGCAGCC | 5491 | 5507 | 459744 | 459760 | 3654 |

TABLE 58

5-8-4 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1385293 | TCAGTTTAGTTGCAGCC | 5491 | 5507 | 459744 | 459760 | 3638 |
| 1385294 | GGTCATTTATTGTCACA | 4765 | 4781 | 459018 | 459034 | 3634 |
| 1385295 | CCGAGTTGTCCATAGTC | 4437 | 4453 | 458690 | 458706 | 3635 |
| 1394533 | CAGTTTAGTTGCAGCCA | 5490 | 5506 | 459743 | 459759 | 3639 |
| 1394534 | CGAGTTGTCCATAGTCA | 4436 | 4452 | 458689 | 458705 | 3649 |
| 1394537 | GCACCCGAGTTGTCCAT | 4441 | 4457 | 458694 | 458710 | 3656 |
| 1394538 | CAGCCCGTATTCCTCTT | 5918 | 5934 | 460171 | 460187 | 3657 |
| 1394539 | CACCCGAGTTGTCCATA | 4440 | 4456 | 458693 | 458709 | 3658 |
| 1394540 | GAGTTGTCCATAGTCAT | 4435 | 4451 | 458688 | 458704 | 3659 |
| 1394541 | CCCGTATTCCTCTTACC | 5915 | 5931 | 460168 | 460184 | 3660 |
| 1394543 | AGCCCGTATTCCTCTTA | 5917 | 5933 | 460170 | 460186 | 3661 |
| 1394544 | AGTTTAGTTGCAGCCAT | 5489 | 5505 | 459742 | 459758 | 3662 |
| 1394545 | GTATTCCTCTTACCATC | 5912 | 5928 | 460165 | 460181 | 3663 |
| 1394546 | TTCAGTTTAGTTGCAGC | 5492 | 5508 | 459745 | 459761 | 3640 |
| 1394547 | CCCGAGTTGTCCATAGT | 4438 | 4454 | 458691 | 458707 | 3636 |
| 1394548 | CGTATTCCTCTTACCAT | 5913 | 5929 | 460166 | 460182 | 3664 |
| 1394549 | TGTTCAGTTTAGTTGCA | 5494 | 5510 | 459747 | 459763 | 3665 |
| 1394550 | TATTCCTCTTACCATCA | 5911 | 5927 | 460164 | 460180 | 3666 |
| 1394551 | CCGTATTCCTCTTACCA | 5914 | 5930 | 460167 | 460183 | 3667 |
| 1394552 | GCCCGTATTCCTCTTAC | 5916 | 5932 | 460169 | 460185 | 3668 |
| 1394553 | TTGTTCAGTTTAGTTGC | 5495 | 5511 | 459748 | 459764 | 3669 |

The compounds in table 59 are 5-10-5 MOE gapmers with mixed internucleoside linkages. The gapmers are 20 nucleosides in length wherein the central gap segment consists of ten 2'-β-D-deoxynucleosides, the 5' wing segment consists of five 2'-MOE nucleosides, and the 3' wing segment consists of five 2'-MOE nucleosides. The sugar motif of the gapmers is (from 5' to 3'): eeeeeddddddddddeeeee; wherein 'd' represents a 2'-β-D-deoxyribosyl sugar moiety, and 'e' represents a 2'-MOE sugar moiety. The gapmers have an internucleoside linkage motif of (from 5' to 3'): sooosssssssssssooss; wherein "s" represents a phosphorothioate internucleoside linkage and "o" represents a phosphodiester internucleoside linkage. All cytosine residues are 5-methylcytosines.

TABLE 59

5-10-5 MOE gapmers with mixed PO/PS internucleoside linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1371311 | CCCGTATTCCTCTTACCATC | 5912 | 5931 | 460165 | 460184 | 3590 |
| 1371320 | TGTGGCAGCCCGTATTCCTC | 5920 | 5939 | 460173 | 460192 | 3585 |
| 1371322 | CACCCGAGTTGTCCATAGTC | 4437 | 4456 | 458690 | 458709 | 3593 |

TABLE 59-continued 5-10-5 MOE gapmers with mixed PO/PS internucleoside
linkages complementary to human ATXN1

| Compound Number | SEQUENCE | SEQ ID No: 1 Start Site | SEQ ID No: 1 Stop Site | SEQ ID No: 2 Start Site | SEQ ID No: 2 Stop Site | SEQ ID No. |
|---|---|---|---|---|---|---|
| 1371325 | GCACCCGAGTIGTCCATAGT | 4438 | 4457 | 458691 | 458710 | 3605 |
| 1394162 | TTGTTCAGTTTAGTTGCAGC | 5492 | 5511 | 459745 | 459764 | 3655 |
| 1394163 | CCGTATTCCTCTTACCATCA | 5911 | 5930 | 460164 | 460183 | 3588 |

Example 5: Tolerability of Modified Oligonucleotides Complementary to Human ATXN1 in Rats, Long-Term Assessment In separate studies run under the same conditions, modified oligonucleotides described above were tested in Sprague Dawley rats to assess the long-term tolerability of the oligonucleotides. Sprague Dawley rats each received a single intrathecal (IT) delivered dose of 3 mg of oligonucleotide or PBS. Each animal was weighed and evaluated weekly by a trained observer for adverse events. Adverse events were defined as neurological dysfunction not typical in PBS-treated control animals, including, but not limited to: abnormal limb splay, abnormal gait, tremors, abnormal respiration, paralysis, and spasticity. Animals treated with Compound No. 994509, Compound No. 1040500, Compound No. 1041927, Compound No. 1055001, Compound No. 1371311, or Compound No. 1385293 achieved no adverse events for the duration of the study.

Example 6: Activity of Modified Oligonucleotides Complementary to Human ATXN1 in Transgenic Mice A transgenic mouse model was developed in the laboratories of Drs. Harry Orr and Michael Koob at the University of Minnesota. The construct contains human Atxn1 exon 8, intron 8 and exon 9 including the entire 3' UTR (Banfi et al. Nat. Genet. 7: 513-520, 1994) (including nucleosides 435531-464889 of SEQ ID NO:2) flanked by Frt sites for FLP recombinase and the selection marker Hygro flanked by LoxN sites for CRE recombinase. The construct was injected into mouse blastocysts. The human sequence of exon 8, intron 8 and exon 9 replace the mouse Atxn1 exon 7, intron 7, and exon 8. The Hygro cassette was removed via recombination to generate chimeric mice expressing human coding sequence exon 8 and exon 9. Human RNA expression is found in brain and spinal cord in this model. There is a one base deletion causing a stop codon at amino acid 190, so protein is not generated.

Transgenic mice described above were used to test activity of modified oligonucleotides described above.
Treatment
ATXN1 transgenic mice were treated with a single ICV bolus of 300 µg of modified oligonucleotide. A group of 3-4 mice received PBS as a negative control on each treatment day, and the PCR values were normalized to the PBS control group for mice treated on the same day. In some cases, individual mice treated with a given modified oligonucleotide were treated on different days, and the reported results for each modified oligonucleotide in the table below represent the average across 1-3 independent experiments representing 1-5 treated mice for each modified oligonucleotide.

RNA Analysis
Two weeks post treatment, mice were sacrificed, and RNA was extracted from cortical brain tissue for real-time qPCR analysis of RNA expression of ATXN1 using primer probe set RTS37573 (described herein above). Results are presented as percent change of RNA, relative to PBS control, normalized to mouse cyclophilin A. Data indicated as "n.d." (no data) means that no data are available for that tissue for that compound.
As shown in the table below, treatment with modified oligonucleotides resulted in reduction of ATXN1 RNA in comparison to the PBS control.

TABLE 60

Reduction of human ATXN1 RNA in transgenic mice

| Compound Number | ATXN1 RNA (% control) |
|---|---|
| 994334 | 88 |
| 994341 | 80 |
| 994346 | 74 |
| 994351 | 51 |
| 994366 | 99 |
| 994367 | 83 |
| 994374 | 82 |
| 994375 | 88 |
| 994398 | 30 |
| 994408 | 72 |
| 994409 | 80 |
| 994413 | 18 |
| 994417 | 95 |
| 994418 | 54 |
| 994419 | 28 |
| 994421 | 15 |
| 994424 | 62 |
| 994429 | 63 |
| 994430 | 36 |
| 994434 | 63 |
| 994437 | 22 |
| 994442 | 76 |
| 994443 | 62 |
| 994447 | 52 |
| 994448 | 62 |
| 994449 | 58 |
| 994453 | 58 |
| 994458 | 24 |
| 994459 | 36 |
| 994460 | 50 |
| 994464 | 49 |
| 994465 | 65 |
| 994467 | 59 |
| 994468 | 43 |
| 994469 | 32 |
| 994484 | 50 |
| 994485 | 90 |
| 994486 | 37 |
| 994491 | 51 |
| 994492 | 37 |

TABLE 60-continued

Reduction of human ATXN1 RNA in transgenic mice

| Compound Number | ATXN1 RNA (% control) |
|---|---|
| 994493 | 19 |
| 994494 | 26 |
| 994495 | 48 |
| 994501 | 69 |
| 994502 | 67 |
| 994503 | 63 |
| 994506 | 56 |
| 994507 | 73 |
| 994508 | 81 |
| 994509 | 33 |
| 994517 | 89 |
| 994518 | 45 |
| 994520 | 48 |
| 994522 | 55 |
| 994526 | 36 |
| 994527 | 38 |
| 994539 | 63 |
| 994540 | 44 |
| 994541 | 82 |
| 994543 | 91 |
| 994545 | 59 |
| 994559 | 84 |
| 994561 | 65 |
| 994562 | 57 |
| 994564 | 73 |
| 994567 | 81 |
| 994569 | 46 |
| 994571 | 75 |
| 994809 | 57 |
| 994810 | 50 |
| 994811 | 43 |
| 994813 | 66 |
| 994819 | 46 |
| 994823 | 42 |
| 994829 | 86 |
| 994831 | 91 |
| 994836 | 94 |
| 994840 | 71 |
| 994841 | 67 |
| 994854 | 89 |
| 994856 | 72 |
| 994857 | 73 |
| 994859 | 78 |
| 994874 | 88 |
| 994876 | 81 |
| 994877 | 42 |
| 994878 | 92 |
| 994885 | 61 |
| 994887 | 71 |
| 994895 | 52 |
| 994904 | 33 |
| 994906 | 68 |
| 994913 | 18 |
| 994921 | 51 |
| 994925 | 91 |
| 1040083 | 83 |
| 1040084 | 39 |
| 1040085 | 48 |
| 1040092 | 62 |
| 1040107 | 104 |
| 1040109 | 59 |
| 1040146 | 55 |
| 1040151 | 64 |
| 1040170 | 56 |
| 1040173 | 94 |
| 1040180 | 93 |
| 1040191 | 108 |
| 1040198 | 107 |
| 1040199 | 69 |
| 1040203 | 75 |
| 1040207 | 75 |
| 1040213 | 85 |
| 1040223 | 60 |
| 1040227 | 80 |
| 1040231 | 56 |
| 1040236 | 91 |
| 1040237 | 59 |
| 1040238 | 79 |
| 1040239 | 72 |
| 1040248 | 82 |
| 1040297 | 63 |
| 1040299 | 48 |
| 1040328 | 17 |
| 1040329 | 32 |
| 1040334 | 84 |
| 1040335 | 90 |
| 1040337 | 51 |
| 1040338 | 66 |
| 1040389 | 92 |
| 1040413 | 81 |
| 1040435 | 81 |
| 1040438 | 75 |
| 1040442 | 85 |
| 1040472 | 93 |
| 1040475 | 44 |
| 1040479 | 27 |
| 1040500 | 38 |
| 1040502 | 84 |
| 1040512 | 49 |
| 1040514 | 74 |
| 1040597 | 92 |
| 1040601 | 72 |
| 1041318 | 49 |
| 1041319 | 88 |
| 1041326 | 82 |
| 1041328 | 51 |
| 1041334 | 90 |
| 1041339 | 90 |
| 1041345 | 87 |
| 1041355 | 63 |
| 1041366 | 71 |
| 1041390 | 41 |
| 1041398 | 48 |
| 1041400 | 72 |
| 1041406 | 98 |
| 1041409 | 37 |
| 1041413 | 62 |
| 1041425 | 69 |
| 1041429 | 65 |
| 1041433 | 73 |
| 1041434 | 103 |
| 1041438 | 85 |
| 1041439 | 66 |
| 1041441 | 86 |
| 1041443 | 101 |
| 1041455 | 77 |
| 1041469 | 75 |
| 1041471 | 48 |
| 1041486 | 48 |
| 1041489 | 101 |
| 1041498 | 43 |
| 1041527 | 95 |
| 1041532 | 85 |
| 1041537 | 87 |
| 1041548 | 98 |
| 1041550 | 114 |
| 1041557 | 83 |
| 1041567 | 71 |
| 1041575 | 103 |
| 1041597 | 119 |
| 1041603 | 96 |
| 1041605 | 82 |
| 1041608 | 76 |
| 1041623 | 64 |
| 1041636 | 70 |
| 1041649 | 94 |

TABLE 60-continued

Reduction of human ATXN1 RNA in transgenic mice

| Compound Number | ATXN1 RNA (% control) |
|---|---|
| 1041653 | 84 |
| 1041676 | 91 |
| 1041679 | 88 |
| 1041682 | 103 |
| 1041699 | 75 |
| 1041729 | 79 |
| 1041733 | 113 |
| 1041736 | 72 |
| 1041746 | 42 |
| 1041757 | 66 |
| 1041768 | 63 |
| 1041769 | 47 |
| 1041776 | 99 |
| 1041777 | 86 |
| 1041927 | 37 |
| 1042257 | 105 |
| 1042471 | 60 |
| 1055001 | 27 |
| 1055004 | 34 |
| 1055006 | 46 |
| 1055007 | 34 |
| 1055012 | 63 |
| 1055013 | 76 |
| 1055014 | 50 |
| 1055017 | 92 |
| 1055020 | 71 |
| 1055025 | 95 |
| 1055027 | 73 |
| 1055035 | 68 |
| 1055046 | 98 |
| 1055050 | 73 |
| 1342029 | 49 |
| 1342030 | 107 |
| 1342031 | 80 |
| 1342032 | 48 |
| 1342033 | 77 |
| 1342034 | 92 |
| 1342035 | 89 |
| 1342036 | 60 |
| 1342037 | 89 |
| 1342038 | 63 |
| 1342039 | 86 |
| 1342040 | 117 |
| 1342041 | 58 |
| 1342042 | 80 |
| 1342043 | 95 |
| 1342044 | 78 |
| 1342045 | 101 |
| 1342046 | 83 |
| 1342047 | 86 |
| 1342048 | 64 |
| 1342049 | 88 |
| 1342050 | 107 |
| 1342051 | 80 |
| 1342052 | 98 |
| 1342053 | 87 |
| 1342054 | 106 |
| 1342055 | 97 |
| 1342056 | 86 |
| 1342057 | 99 |
| 1342058 | 55 |
| 1342059 | 97 |
| 1342060 | 107 |
| 1342061 | 86 |
| 1342062 | 73 |
| 1342063 | 68 |
| 1342064 | 68 |
| 1342065 | 76 |
| 1342066 | 98 |
| 1342067 | 25 |
| 1342068 | 58 |
| 1342069 | 83 |
| 1342070 | 94 |
| 1342071 | 88 |
| 1342072 | 82 |
| 1342073 | 77 |
| 1342074 | 74 |
| 1342075 | 43 |
| 1342076 | 86 |
| 1342077 | 69 |
| 1364280 | 36 |
| 1364281 | 48 |
| 1364282 | 41 |
| 1364283 | 26 |
| 1364285 | 29 |
| 1365254 | 65 |
| 1365255 | 62 |
| 1365258 | 123 |
| 1365259 | 121 |
| 1365260 | 94 |
| 1365261 | 49 |
| 1365262 | 76 |
| 1365263 | 69 |
| 1365264 | 43 |
| 1365265 | 34 |
| 1365267 | 44 |
| 1365268 | 44 |
| 1365270 | 49 |
| 1365271 | 28 |
| 1365272 | 38 |
| 1365274 | 46 |
| 1365275 | 51 |
| 1365278 | 81 |
| 1365281 | 71 |
| 1365282 | 92 |
| 1365283 | 83 |
| 1365284 | 92 |
| 1365285 | 76 |
| 1365286 | 79 |
| 1365287 | 61 |
| 1365288 | 71 |
| 1365289 | 72 |
| 1365290 | 69 |
| 1365291 | 55 |
| 1365292 | 45 |
| 1365293 | 94 |
| 1365294 | 65 |
| 1365297 | 96 |
| 1365298 | 53 |
| 1365299 | 75 |
| 1365300 | 51 |
| 1367569 | 80 |
| 1367572 | 53 |
| 1367573 | 44 |
| 1367575 | 99 |
| 1367576 | 89 |
| 1367577 | 52 |
| 1367580 | 46 |
| 1367581 | 42 |
| 1367586 | 66 |
| 1367588 | 59 |
| 1367589 | 19 |
| 1367590 | 80 |
| 1367591 | 21 |
| 1371311 | 24 |
| 1371320 | 66 |
| 1371322 | 79 |
| 1371325 | 48 |
| 1371806 | 52 |
| 1371807 | 70 |
| 1371808 | 78 |
| 1371809 | 62 |
| 1371810 | 50 |
| 1371811 | 74 |
| 1371812 | 89 |
| 1371813 | 112 |

TABLE 60-continued

Reduction of human ATXN1 RNA in transgenic mice

| Compound Number | ATXN1 RNA (% control) |
|---|---|
| 1371814 | 70 |
| 1371815 | 76 |
| 1371816 | 51 |
| 1371817 | 62 |
| 1371818 | 35 |
| 1371819 | 49 |
| 1371820 | 68 |
| 1371821 | 62 |
| 1371822 | 60 |
| 1371823 | 90 |
| 1371824 | 60 |
| 1371825 | 29 |
| 1371826 | 70 |
| 1371827 | 59 |
| 1371828 | 63 |
| 1371829 | 32 |
| 1371830 | 60 |
| 1371831 | 86 |
| 1371832 | 84 |
| 1371833 | 81 |
| 1371834 | 89 |
| 1371835 | 92 |
| 1371836 | 111 |
| 1371837 | 96 |
| 1371838 | 90 |
| 1371839 | 81 |
| 1371840 | 87 |
| 1371841 | 83 |
| 1371842 | 29 |
| 1371843 | 71 |
| 1371844 | 59 |
| 1371845 | 73 |
| 1371846 | 62 |
| 1371847 | 82 |
| 1371848 | 38 |
| 1371849 | 72 |
| 1371850 | 78 |
| 1371851 | 49 |
| 1371852 | 89 |
| 1371853 | 66 |
| 1371854 | 37 |
| 1371855 | 36 |
| 1371856 | 77 |
| 1371857 | 76 |
| 1371858 | 104 |
| 1371859 | 94 |
| 1371860 | 98 |
| 1371861 | 86 |
| 1371862 | 75 |
| 1371863 | 68 |
| 1371864 | 81 |
| 1371865 | 87 |
| 1371866 | 58 |
| 1371867 | 83 |
| 1371868 | 85 |
| 1371869 | 70 |
| 1371870 | 46 |
| 1371871 | 60 |
| 1371872 | 56 |
| 1371873 | 78 |
| 1371874 | 77 |
| 1371875 | 17 |
| 1371876 | 39 |
| 1371877 | 48 |
| 1385293 | 31 |
| 1385294 | 25 |
| 1385295 | 27 |
| 1394153 | 41 |
| 1394154 | 65 |
| 1394155 | 49 |
| 1394156 | 40 |
| 1394157 | 30 |
| 1394158 | 33 |
| 1394159 | 24 |
| 1394160 | 30 |
| 1394161 | 29 |
| 1394162 | 45 |
| 1394163 | 35 |
| 1394164 | 42 |
| 1394165 | 43 |
| 1394166 | 43 |
| 1394167 | 28 |
| 1394168 | 33 |
| 1394507 | 46 |
| 1394508 | 63 |
| 1394510 | 66 |
| 1394511 | 77 |
| 1394512 | 54 |
| 1394513 | 38 |
| 1394514 | 73 |
| 1394515 | 87 |
| 1394516 | 72 |
| 1394517 | 91 |
| 1394518 | 73 |
| 1394522 | 40 |
| 1394523 | 86 |
| 1394524 | 32 |
| 1394525 | 43 |
| 1394526 | 8 |
| 1394527 | 68 |
| 1394528 | 71 |
| 1394529 | 38 |
| 1394530 | 38 |
| 1394531 | 65 |
| 1394532 | 42 |
| 1394533 | 38 |
| 1394534 | 66 |
| 1394537 | 45 |
| 1394538 | 54 |
| 1394539 | 58 |
| 1394540 | 59 |
| 1394541 | 67 |
| 1394543 | 46 |
| 1394544 | 43 |
| 1394545 | 66 |
| 1394546 | 26 |
| 1394547 | 53 |
| 1394548 | 88 |
| 1394549 | 51 |
| 1394550 | 92 |
| 1394551 | 48 |
| 1394552 | 33 |
| 1394553 | 85 |

Example 7: Activity of Modified Oligonucleotides Complementary to Human ATXN1 in Transgenic Mice, Multiple Doses Modified oligonucleotides described above were tested in the ATXN1 transgenic mice described herein above.

Treatment

ATXN1 transgenic mice were divided into groups of 3-4 mice each. Each mouse received a single ICV bolus of modified oligonucleotide at the doses described in the tables below and were sacrificed two weeks later. A group of 4 mice received PBS as a negative control for each experiment. Each table represents a separate experiment.

RNA Analysis

After two weeks, mice were sacrificed, and RNA was extracted from cortical brain tissue for real-time PCR analysis of measurement of RNA expression of ATXN1 using primer probe set RTS37573. Results are presented as percent change of RNA, relative to PBS control, normalized to mouse cyclophilin A (measured by primer-probe set m_cyclo24 described herein above). ED50 values were calculated in GraphPad Prism. N/A means that an ED50 value could not be reliably calculated for that experiment.

As shown in the tables below, treatment with modified oligonucleotides resulted in dose-dependent reduction of ATXN1 RNA in comparison to the PBS control.

TABLE 61

Dose-dependent percent reduction of human ATXN1 RNA in the cortex of transgenic mice

| Compound ID | Dose (µg) | ATXN1 RNA (% control) | ED50 (µg) |
|---|---|---|---|
| 1040479 | 10 | 97 | 669.1 |
|  | 30 | 86 |  |
|  | 100 | 87 |  |
|  | 300 | 59 |  |
|  | 700 | 51 |  |
| 1040500 | 10 | 87 | 126.2 |
|  | 30 | 83 |  |
|  | 100 | 59 |  |
|  | 300 | 44 |  |
|  | 700 | 22 |  |
| 1367591 | 10 | 80 | 40.59 |
|  | 30 | 66 |  |
|  | 100 | 32 |  |
|  | 300 | 23 |  |
|  | 700 | 22 |  |
| 1371311 | 10 | 76 | 36.11 |
|  | 30 | 57 |  |
|  | 100 | 45 |  |
|  | 300 | 19 |  |
|  | 700 | 14 |  |
| 1371875 | 10 | 70 | 30.41 |
|  | 30 | 67 |  |
|  | 100 | 25 |  |
|  | 300 | 12 |  |
|  | 700 | 9 |  |
| 1394161 | 10 | 71 | 36.04 |
|  | 30 | 68 |  |
|  | 100 | 35 |  |
|  | 300 | 18 |  |
|  | 700 | 8 |  |

TABLE 62

Dose-dependent percent reduction of human ATXN1 RNA in transgenic mice

| | | Cortex | |
|---|---|---|---|
| Compound ID | Dose (µg) | ATXN1 RNA (% control) | ED50 (µg) |
| 1041409 | 10 | 94 | 277.3 |
|  | 30 | 88 |  |
|  | 100 | 78 |  |
|  | 300 | 56 |  |
|  | 700 | 34 |  |
| 1055001 | 10 | 91 | 144 |
|  | 30 | 89 |  |
|  | 100 | 75 |  |
|  | 300 | 23 |  |
|  | 700 | 18 |  |
| 1055007 | 10 | 104 | 156.9 |
|  | 30 | 88 |  |
|  | 100 | 75 |  |
|  | 300 | 31 |  |
|  | 700 | 22 |  |
| 1371827 | 10 | 92 | 87.95 |
|  | 30 | 77 |  |
|  | 100 | 50 |  |

TABLE 62-continued

Dose-dependent percent reduction of human ATXN1 RNA in transgenic mice

| | | Cortex | |
|---|---|---|---|
| Compound ID | Dose (µg) | ATXN1 RNA (% control) | ED50 (µg) |
|  | 300 | 34 |  |
|  | 700 | 22 |  |

TABLE 63

Dose-dependent percent reduction of human ATXN1 RNA in transgenic mice

| | | Cortex | |
|---|---|---|---|
| Compound ID | Dose (µg) | ATXN1 RNA (% control) | ED50 (µg) |
| 994823 | 10 | 110 | 308.3 |
|  | 30 | 96 |  |
|  | 100 | 72 |  |
|  | 300 | 64 |  |
|  | 700 | 32 |  |
| 1385293 | 10 | 90 | 93.14 |
|  | 30 | 75 |  |
|  | 100 | 63 |  |
|  | 300 | 25 |  |
|  | 700 | 15 |  |

TABLE 64

Dose-dependent percent reduction of human ATXN1 RNA in transgenic mice

| | | Cortex | |
|---|---|---|---|
| Compound ID | Dose (µg) | ATXN1 RNA (% control) | ED50 (µg) |
| 994492 | 10 | 78 | 72.25 |
|  | 30 | 72 |  |
|  | 100 | 52 |  |
|  | 300 | 41 |  |
|  | 700 | 22 |  |
| 994509 | 10 | 80 | 27.84 |
|  | 30 | 53 |  |
|  | 100 | 30 |  |
|  | 300 | 20 |  |
|  | 700 | 17 |  |

TABLE 65

Dose-dependent percent reduction of human ATXN1 RNA in transgenic mice

| | | Cortex | |
|---|---|---|---|
| Compound ID | Dose (µg) | ATXN1 RNA (% control) | ED50 (µg) |
| 1041927 | 10 | 72 | 52.22 |
|  | 30 | 71 |  |
|  | 100 | 41 |  |
|  | 300 | 29 |  |
|  | 700 | 33 |  |
| 994419 | 10 | 83 | 50.14 |
|  | 30 | 65 |  |
|  | 100 | 46 |  |
|  | 300 | 22 |  |
|  | 700 | 17 |  |

TABLE 65-continued

Dose-dependent percent reduction of human ATXN1 RNA in transgenic mice

| Compound ID | Dose (µg) | Cortex ATXN1 RNA (% control) | ED50 (µg) |
|---|---|---|---|
| 1394155 | 10 | 72 | 105.4 |
| | 30 | 70 | |
| | 100 | 60 | |
| | 300 | 41 | |
| | 700 | 40 | |

SEQUENCE LISTING (3675 sequences)

SEQ ID NO: 1 - DNA, 10636 bp, Homo sapiens
  source 1..10636: mol_type = genomic DNA
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagttttacctcacaaaaactactacaagcaccaagctccctgatggaaaggagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 2 - DNA, 468000 bp, Homo sapiens
  source 1..468000: mol_type = genomic DNA
aatattttgccatctgaaaacaaaatatttcagtactaaaggtaatgagacagtttcatgagtatggtgtttatgttggatcttgcaggaagaaatagttacagattttggtggcagtttatggctttaaacttaatggctaagaaagtaaatgacacatttcttattaattgtttttaccatttgggtaatatacatatttagcttccttgagagaacatttaaattaattgactaactgtaatctgaattatgtgttttaatttaaggttgttaaaatcacgtaaattaactgcttgtgccaacgtaaaattacaatattagcttttttttaactgaaaattatctaaatgtaagatgtctaaaaatagagtggaggtggattggacagtttgcagattatgagttggaataaaaacatcgcagttaagccaaaaacatggcaaccaatattttctgttataaaaatatttgagatgaatttagtttttatgaaagctgtctgaaactgaaatgaatagcagaagctttctgtttattcacagtccagtaataataatacctgcagcacaaagcatacgtcttttctatataaagccaacaagcttctgctcctttctgaagtcgtctttgccaagcagggtgttgggggcgggggtgaggataggggtgaggggacattttacccggttatgctcttacgtactaaccttcaccttgacaaagcttgtcaacgaaaacaaaaccagtcagagccttttcaggaaactgatgttaactgtccactagaggctgtaatgagaccaacaatgtcactttagaccaacccgaggtttaaaccgtaacaataatcgatttttaaatggaaaaaaaaaagttgtagaaatgagtaagagtgaacactagtagttatacttaaatagccacatatatgtgcatggtatttcaaaaatgtgagaaaaaaatatttccggggctctgcaccttcctcgctcgtatgtttatttttatttatgaagcacgtaggctcttgcaggccagagttgtgtaaaaactgacactttttttttggtcatcctgtgccctgcctcagttggtgactaaccgttaggtcataagtaaactcagccaaaagatctctcaaatacagcttacagtcaagattggtggctttcagaaagaaacttacgcgaaaggatcatgtttccagacacttagttctaagcacctgaagaaggtcaaatgtcgcccgacacctaccggccttccagaatcatctgcaacaagaacgccgcactgagcgcccttagtctggaggcgcctcctagtcctccaggtgccacacctgttggcaaggtgcacccatccgaagaagattccttcgcgtggaggtcacacctggcggcgagacaggcggaggggcggggtggtgggagtcggagaccgcactgaaaccctgagtccagatttaagttcctcgtcgattctcgagaactgccatttgatgctccggttgctttctctgtctcctacactggttacctcatttccgattaaattaatgatccgaaattagctgcgagaggagtgcgcgggtctcctttccaggctagagcggagtagttccatatcaaagccgatttccggacctgcgtgcgaagagagaaagagggcagggtcgggcggtcgccagcgttcgccggcaggaaaggtgagggtacctgtgcagtcgggggaccccttgaaactttccggagttgcacgcagaggcaatccccgcggcccccaggcctgggttccggaacgccgaagcgacgccggtttgtggcttaacgtgcagctgatgatcagagtgagccctctcagatgctgctccgagcgcctgggaccaaggacacgtcgggattagaatgggccgacctcccctccccgctggggtgttgcatcggctcccagctgaagcctgacagcccttgggggagtcccccaggttgcctgagtagcgccccgttgtcgttcagtcccctccaactaggtgcagggacccagggaggcgcgcgaggaccgacccgtcaccgctcaaattacctcatcgcccagctccccgcccccttcccaaacctggaaggaaccttgccctccggtccgcgtctcccctcccccgcaccccatcccgagccactctttgggaaaggtgcccgcctccccgggcggcgcgcagcgaagggttaagggcgcgggccggccgccgcgcggtgcgctcgccgtgctctgtgcggctcgccgggccgcccgccagagggtgccccccacccccatgaagtcggatccttgagctgcggcggcggcagccaactgctccatatttggcttctattacacatttacatactggagcgagcgagcgagcgagcgcgagagagcgcgagggagggagggagggcgggcgggcggagggaggagggaggggaggggagcgggaggagggggaggaggaggaggaggaggaggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagtaagtgactatttttttttcctcctccgattctttcccccctcccccattcccttctccccttatttagattaaaatccctcctcccccgatctcccgagaggggcaaaagcaacaaccagcaaacaaacccaaaaccccaatcggctgcacggaaaacagctggaagaggagcgaaggaaatcgacgcgtcgtgttctgtgtgtgtgcgtgtgtgtgtgtgtgtgtgtgtatgtgtgtacatacaaccgtccccggctccaggctcccgggccgacacccccactctgggcgcaggggcggccggcgggggggctgtcaggggctgggtgggcgcccgccgggctagggggcgcgcccgggcggggggcgcgggcggggagagcggcggcggcgccccgctcccccggctgctggtccggtcgcaagtgcggagagccatgtcctcctccctccgggtggcgcaggggggaggcggcggctggggttggggggtggtccctttcccggccgccctcttcccattcctcctccccggagagggcggtgagagagagggggtctcacggagggctggacttctccgcgggtggtcgcccggcctcggcgccctggggcgggggtctcccctcggagggccggcctcgccgggtgtgcggctgcgggcggggaagggactgctcctgcagccgggacgggactttgcgcgcggccgggtgccgggcggggggcgcagaggggtggcctcggggaccgcgcgggggtagcgggtgtgcgggtgcctggagcgcggctggagtggcggtgacggccctggccgccgccgccaccgccgccctgttggtgcggccgcttcctgatcatgtgcagcggcagccgccgcccggagccgggagcccgcgagcgccccagtccgggccggcgcccccgccagcacccgcggcaggagacgaggagccgcggcaggcgctgccctgagccgggagtgaacggctgcgcggctgctgggagggtgaatgaagccaggaggaggggaaggaggaggaggcggcggccgccgcggaggaggcgctgcggggattgggatgcgccctggagccccactgctcgttcactctgggccgggccggagactctgccactcccgggggcgccgccgcctcctcctacgtggttccagtgctgcgcgcaggccggtcccgcagggggcagggaagggggccggacgggcggagcgagaggtgaggcggtgtcggagcgcggcgtgagtgtgagtgagtgtgtgagtgactgtgtgtgtgtatttgtgcgcgcgcgcgccgggcggggggcgagggccgtcgcgacgcggagggggcccttccttggctacttggctgactctgcagcgccccgacccctcttcagccccccgccttcaggctgccttcttaaactccgtggcttgtgctttcattttgtttcagaccacgtagggggctgactgaaagggatgaaacaattcaggttttctagggagattgagcaagaaccttagtgggggtggaagtagggtggtgatcgagactctgccagaaaacaaaacaaaacaaaaaaaaatccgtttctaaggacggcggggattcggttcgagcccgtggctgctctgttttgttttgctttcttggtatataatcctacagataaaagggtaatataaatatttgagaagagggaaattgctgaagagtagtaagggcaaaaaaaaaaaaaaaaaaaaaaaaaaaacagtcggaagaagctggttatataatgcgcgatgtggctaacaagaaaggcaagctatttttattttgtttaccgtatgctgtgcagtagggactcctccaaactggttctgtccccgaagagattcttagcttccctgcgagatccacaggatacaattagcaaaattagaagaccctattacacccacagaataaaaactaatgccttacagtggctttctccctgcacatcctgtcgtgcatgcacgggaatgtgtgtatgcaaataagttctcctttggcaatctagtagtcacatctcaatgacatttgtgttttataatgcaggctgtttttaatatttaaacatcattgttatatattgcacacagcagtgggtagttacttggttatttttaggcacagctagttactttttcaacagtgttagctgagacatttctgtttgggttttttaggaggctgcagttcctagaagccccccttaagcccacccttcggtttatttgatgggtaaaggtagtttgatacttgagctttttttggagtgaagcttatgtctgaggaaaccaccagagagaagagaaaatcctgcacaggaactcttggaaagggattgcaccataacggctagcgctgtggcatttaatctcctctgattgccctctcactgtgcatgcatcagtcaatattttagcagctccgcaaataaatggacttgaatgccatcttctacataaagcagaggttgaagggctcccctgaacctcctggctgcctgtcagtggtgtaggttttcggtgcacttactccagtcctgatcactcatgtaattagatcaggctgccatggcaacagacagtgttcctcgtccattcaggtgggtttgtcttgtgcctgaactactccaagtgttttatgcacagcatttatgctgcccaagccagacgagagactccactatttcaattgcatcttctttcagtcatttggatgggagacactgaatgaggcttctagctactcaacttttataaaggagaccaacaagctgttcttcctaggtgcagtatgtaaatgcatctccccagacagtgaaaggagcctgacaatcctgctggtgtttattgtgaacagatcaacaagtatttggtacttgttagaaacctttcagagctcactaaagcaacatttcttttgcagtctggtgcctttggccttgcagtcagtcacttaaccctttcaagtgtgaagagcgttcatcatttggaacctccattgcccatagcgatggctggatttctaaagggtttactcaggggaataacttattcggaaaatatattcccattgtcacattttaaaacttgacagccatcataacaaaaactggtactgacagtaggcagacattctgaatgtattcattcttaatttggatctattggctgtgatttgaatgatctttggtagtaagttaaaaggatttttttttccttagctaagcgagaaacgatagaggcctatagctagaggactgatagtgcatggtgcttttggacaataaacatgtactttattttaggatgtaatttagtgagcagttagaaagcagtattctagtctttgcattagggcaccactgataaagctggctaagcaaagagaaataatattatggcaaaaaggaaaaaaggaaaagttgctttagttgctgaagctctgtgctgctcaggcaatccaactaagtggggcagggggcgggcgggggggagtattttcataaccctggtatttgaaagaaaagataattgagaattatgtcttgatttagttgtgactgccagtcagtttacaattttatggccaacaaagctaaactggtaaattttttcccccagggctaggattgagagagctactcaactctattcccagggggtttatgagtttttaccgttttgtgagtttatgtggttggtaaattcattgtggcctggtcagatgaagcactgctgtagttaaaatgagctattatttcttctagctactcaacttttataaggtggtaaatagatgggaagcaaggatgtcaatattacacaatgccttggaggtcctggattctattttgcaacatatagaaaaatgctttacttgcagtaaaatgtgaacatatatttttcagtgcacaaataaattcatgtgaaaataagtataaaaaaatgtacctggtgggaaccgccaaaggcaatatttttccttgcggatttcgttttaagagggtttggtaaacagaagtgacactttgtcaaaaatgttacgactagacttcaggacttctgaattgtcttttacacttagaggaagattaaacagaaactctttagccacaagattacatgtcaaatgcctgtaagtttcaacatacctaagtcagttgcctaggagtcctgggaaaggccagtgctgagattattgaaatattagtaaacattactatgactcctgtttttgttgtcattatggagtccaaggacgcacatttctttgaataatgttgtgcctttattgtttttcattctgaaatgtcaagtggattttacttttttgcacataccttgagtgacagtttctgatgactaacactaacactcattttgtttcctattaaaagttaagcaataaacatattttactaaaattctgaaactcacgtaagtaggtaaatgtgggagtgaatgttaattctttaaactgtagttatctgaaaataacacatagattaggatctgaacagcttaaatacttgcatcggtaaagtgacaatagtgaagtaagacaggctattatttttaggggagagatagattatttgactttccttgctctgtattttcagagtaattcaatagttcgaatgattagtttctgtgagagatttagatctgtgcagcttaattgcttcaaataacagatttagttctggtcatacttccaaggttatcagaagcaggccctccttattttgataaaagcattgaaagcaatacattgtagaaatggtaatagaaataataatttctgttttaggaccttacatatagaacttccttttctaagataagaattttaagtcatcaattatgttcacattttattttcatgtaatttagtttaataaaataaatgtactcattcaaaatttttttaagaagtgatatacagtgtcagttttacagaattttttaaatgttggctgaaagaacggtaattacattgagatttttaaaaatatataaatgcttaaaattacagaagtaataaaaagaatggttttagacaaatcttatggaaagttttttattttattcttttataattatatttatggatatttgtctttattagtgtagtaatatattttataacgctcataatttgaactttcaggctaatgtactataaatatttgtattacgcattactaccatcccaaatgtaccaaaacacgtttagagagaacaattatggacaaaaaagcaacaagcattatattttgtttgacatatttcatgttagcagaaatgtttcattgatttttctgtaacttttaatgcatcccatttgtggagtaatgaaaatgtaatgataattgccacaatgtaagcaaaaattgtatcctacctgaaaattactttccagaaaattcatggtagtgtactcagaatttgagactcaagagggcagaggtttccccgattgtgatgttttgatttgggctaagaggaactctttttttttttttttacacttaggtgccctttaacatgacaagttttgaatgagttaggtagcagaagtttttcgtgacagttattgtagctactaacctatagcatctatccttctaacgttcaaagaaaatatatttttctgtcactgtgtatggcaaactttattttcttgtgcccttaattttgttcccctttctcacattatctcctggtacttactgaccattacctcagttttgtttaggccgtctttcttgttaatcttccaatattaatagtattgtattatgttgctctgctgggttttaaaaatattgagtattccatttttggtgtatattattgtataaaatgtcctataaattattttctggtatattattttgtaagtttttgcagtgaatacgtgctgccttgcttgtattcttgccttcttccctctgatggaatacaagttatgtaaactctctgtattatcctaactagtgcagcaacacaaatacttttgaaataagaaagcatactcatgcaagagtaaagtaatcttctatggcatttacatcatgtttgaccctcctctgcacttcagcaaactaggaggaggttgtaacttggactctataaaaccttatctgccaggtgatatgtaaacaggattgtgtgcacacacattgtcatataggcaaacactctcccaactggtgagctcataaaaagcactgtctgtaaatttatggtacctgcacctcatttgagaatcaagtattttgatgcttaatttgagatgacatcatgatcctccctccctgcttcctcatccttaaagaagtactaagattaaatagaattttgtcaacttctacttaacttggccattatttatatttgtaactcaacaggcttcttggtggagggactgtgccttctaaagatctgaaagaccttatagtgtataacagcttaccttccttctctgtacgcacagatcacatgtggggaaaccaaggactacaagaattccttcttttgcatatcagtcctcggcaggcaatcaatgcttaaataaatgcttggtgaatggattagttagaagtaagaacattttggctactgttcattactttgaaaagtgctggaaagaagtggaagttattttcctttccagctgggctgtgctcttaaaaatagtgagtgtgtatggatgaaaataatcatgagtaccgagatgtgttgccatgtacccaaggataattggctcacttacctgtttacggattattcacattggagatcatattcatagctccagaatagtttctttctgacatccaatataaacctgggcctccttcttcctactgttacctggcgtgagcttaggaaacccaaactaagtttaaaatcagcctaagcaaatgtgcagatcagctccagtaatcaaagactgaaaatcagtccagcattcactagtttggggatgattttatagtaaccctgctactgattttaaaaaaatttttttttctgtttaatgtggataattggtaattaccggtatttaagaatataattttaatggatagggctaaaaaaatacgttagcagatcgagtcctcaacttcttccgtttctatgcataggttttacctcacaaaaactactacaagcaccaagctccctgatggaaaggtatatggaagattcattcattctttctttcattcatccattcacacattcactcattcatcatacaatggaaaatttttacttaaccatgtgcaaggaattgtggcaaaatgaaaatgagatgtacattcagtatttaaataaagtttagtggaaagtttagtgaatataaatgcacactttacactttttttctgcattttttcctttcttctattccattggactggtatgctaatagctgtgcactttcatcattgtgtttcaagttgcatgttgatagataatatatgccacattaaaattaggctttggctcaattactattcaatccatgcccattttcacctgatactccttgtagttaccagcatgtgtttatcagatgattggctagaatcattggagaaaagaatgacagcggctggctcaaatggggagaccatcctcttaatttgatggaagggatgacctttttgtatgttggcctccctctgagccttgttgagtaaaaccagacctgccttttgagctggctgggatctgtgtaattctcatacaacagaatgccgaatgtgatgttcttaaaatttgtatttcggtgcatagacacttaaggtggacttattttttaaagcagtctattctgtttttcattttggatttcctctcctgcactccctcgaccattgcaggagcatcgtgcatcaagtcaccagggtggtccattcaagctgcagatttgtttgtcatccttgtacagcaatctcctcctccactgccactacagggaagtgcatcacatgtcaggtgagagttttgcgatgctctctgttttccatctgaggataaagtcctgacctggaaaattgcctcctagccatgctcccttactttgttggctgttgaatatcattttctttgcaaactctgtttgggcatagtgtgggaagttgagaaattgccaagattgttttttaaaacttcgattaaagtatctatctatttggtttaatctatatgttcatgaagactttcatttgactttgcgatgattgataattgccaattggggcttgaacctcatcattttaattgtcagttttccttaatacaattaagaatgctatgctaccagatatcttaagtcacagtttttgcattttagattactgttgtagtataatatgtgcgtagcaaaacagagacctatttgtttaggggaaccagtatttgttgaatcttgaatttctttgtgtctgtttggattttacaacttcctgattttcccacgtacagtaagtttttctggcctggagagtcatgcagacatagggtgtatgcaatggtgatgactcatggttctctattgaagaaagggccagaggatattgcctcaaattaaatcaggaaggaaaaagaggtttgctagaacttggggcagtaagggcttgggaacacaagggtttgagtgtatgtaaccaagggagattgtgaaatagaaaataggggatcaatttctatttgccttggaaatggacctgcttgaaactgtgaagacagactagattagaggttcccaagcctggctaggcaacagaatcacctggagagcttaaaaaaatagaatttggagctccaccctagacttgatgaatcagaatgtttcctgctggaatcattgatctgtctaggcactgatgctccacaggtttgggaacccctgggtcggccggtcttccagcaactcttcctaagttatgttctgtagacttagttggtgagaagctcattctacttttagcaaatctcccatttgaaaatttgaattttcaaaactcatttttcaagaggtagatggatatttgctttataacaggttcatttaaacaataattgaccagatttctttgaagaaagagctgcctctttaccgtaagagccaatttttaagttacatataaattctctggcatcttagataagagcatggagctccgtaatcaacccatctggacttaagatctggagctgccactatgaccttgagtagtcctatgtcctttcaatgcctcagtttattcatgtataagatggaggtaatattagaactttcttatagggctgctgtgaggatggactggagtaaaatagtagatatactgtgggtagaatagtacctggtgtatggtttgtatcttttaacagatgctatcaagtaacttatccctcaacaggttgattgttatggtcatgttttatgatggttgctcctgaaccatacatgactagaaatatgtaaatatacctggaccttggtctttggacccaccctgtagacatctacggctctgcaaagccaaggagccttttatttgtttttgctgaattttaaattctgaatttatcacaactctctgactgatgggatgcatgtgtggtttttttttttttagattgttgtaaaatgaactgatgaattgcatgcataaatgtggttatttgtggtctgagtaaaaataaacaaaaacctgagtgactgaagtattatgcctcaggaaaaacagccaaaaaagtcccagtgggggacaaggtggaggagggaagagtcatcacagacacgatactcttgtaaaatatggaactggattccttacattttattggctgtggattagagaggtgttctttaagtggaaatgtaacctaaagttacatgcaaaggtaagcctcttaagatctacaagtgtcagctgaatgaaaaaggtagggtgggccaggcacagtggctcatgcctttaatcccagcactttgggaggctgaggtgggtgaatcacttgaggtcaggagtttgagaccagcctggccaacatgatgaaatcctgtctctactaaaaatataaaaattagccaggcattgtggcaggttcctgtaatcccagctacttgggacactgaggcaggagaatcgcttgaatcctggaggcagaggttgcagtgagcccaggtctcgccactgcactccagcctgggcgacagagtgagactccatctcaaaaaaaaaaaaaaaaaagagaggaaagaaaagaaaaaggtagagtgtcttactgctactttatctcttagggatgatactcattttaacggttatgtgctaggctgaaaatcctcacatttagatctttggggaaatagtttaattgcaaatgggttgagtacacgtgcattttttttaacctgtggtgttgaaagggagtcatttgtgataacagaaatatctcaagaattttattgtgaaaaaacaggcagcaaaaagtcatatctcttggtcaatatgggcagcttattgagaagagacctaggtttttataatatgttaggcaagtttaagtgtcttatgaatactaaaatactgacgaagtagcgcaaagtcaccttgaattttaagcgctgacattttctatgattgcatttaaagaaagcttataagcattatctaaacattttgcatcaataatggcctcattacagtcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaatttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacggtatgtaactgaccaggacattttgactgaagcctaggtgctggtggacatctgaatttctggattcgagcagacagtagagagtatgggaataaaactgccgagaggtcaagtctgaagataaatttggaggagtccttggcataaaagtgatctttgaaattgggttcttgggcctggcaaaaagtttgacacccaggagggggatgactgaattcagggatgacgtcagctggtgtagaatgtgtagagagaaggtaagaggcagcggagagtagcttcaacattgatgtggcatggccttcgtctgccttcttttcatgatctggggtgaaggaggctgggtggctggaggagttgggtgatgtatgcgtgggccataaggactcttctgcagctcaggcaccttggaaactcagtgctgaactacagttcaatgaaatcttgtcaaaacctctcttcctttaagacctttaaaaaaataggaacttgagctaattttagctaaatctaatgtgtgtgtgtataaaaatgaatgctgcgtttgaaattcagcgtatgcggtatctcgttaaacaaatgatccttctattttcctctaaacagttttattaagattttcagtgaagccctgtacgttttaacaacaattccagcatttctttgatcttttctaccgttgatttattcatctcacatgatatgcgtaaatcacaatgtgccatctacttgactctgtagcaattgttcatttgtggcaattcatttactgtactttgataaaccacattaatttgggtgtgttttgtaactttagaggattccctggaggctttctgcagactctttaaaatgtgagatgtgtgtgtttttgtgcgtgcgtgtatactgtatatacctagctactagacacagctctttgaacaatttggcttcccatttatactttatagaaaataaagagatatagaattggtgaatcttgggtctggggagaaagttagtctaagacttcctgatgtaaagtgaaagagaaggctggagatgatgttacgatgatgttagtgagcagtctgatttaatgtaatgagagaaaatttgaggattaagttgtggtttttttttttggtgctgagttagttaggatgggctctctgtgtagcccaaaagggctcagaataaaagcagtgacttatttaactttcatcaaagacaagaaggttaagacaggaacaagagggatggagcaaacaactccaggggcagatcgttcttgtctgcaattatttaatgagcatctaatgtatgagacgcattatgccaacaaggccctctagggaatatggagatgatcaatagttcacatttactattctgcatattaacttattgaatcctcattacagtcctttgaggtaggcatcattattttctccattgcacaggcgaggaaactgtggcacagagagggtgaataatttccccaaggtttcccagctgttaagtgatagaatcgtgcttggatcccagtctacactctcagccctgttccttaagccctgtccttaagaagcttacagtcgagtgcataaggcaaggcatggcttggagtaatatttaaagagccatgacacaggtaacacagtctaggaagtcaggatcaaggaagggtccttccttggagccttctcttttgatgcctgcctgtctgttcagtcacatatgagctttctgacacaggctgtcccatgcaggctttgtggtgttttctccctttctttcactcttactcatatctccttgagattcctatgcactttcaataattattaattgaagaaaatgatgacagtggcaatttgcttatccgtttcaggggattggcttaagttggatccaaatgttattcagcatcaagagtctcagcgagatgatgaacttttgactcttaaaagaacttcactgggtcattgctcagcttgcaagatttggcagatatgaactatttgtctctccagtgtgataggtggtggtgtggcgctgaacgcaagctctaagaataaaacgtgcagcaaaaggaggtcacgctttagtcagggtggccataaggaagcttagaactcacatcccctctgcccctgcctcgcccagtctcattttctctccttcactagaacagtgaatgaatctgagctcattcatgtcaagatgatagagaagaaagatcactttctcttagctggcttagggaaggccagattgtctttcttacactgagtgaaaaattactgaggacttttgttttttttttttttggtcttcaaggcaacatctcttgcttttacagacccacggaaatcgagaagaggatgcaagatttactattcgtgccctagcctggcagcttcagcctacatcacagctgtaatcatatgtgatgcatttttatttacagattagtaggctctgactctgacatatgactaaccgggaagctcctccctgtaacagttgtatgtcgtctgcttcagagaactaattgcttggcaattcccctttggtaattccctctttattttctgatgagttacttaacagcgatgggcttgttgagcagagcgtggagtttaatgtgtgctccagaaactccactgtaggcctgggggatatgtttttcgagttctgtttagctttactgaaggaacagtgaaaccattatatggcctgttaatatttcactcaataccagattaaacaccgagcagcgtgcagttttccaaaagaaatcaaaaccaggcttctttttaaaatgtgcccctgtgcattagaaaattattaaaaaggaatttaatatgtatagaatgtttaatgatcttttgaaaatatggtttcaaatggagtagtcttccaggaccctacagagtgagtatggtgtgctgttggactggtagtttggaggctcagtttctgttgcctgccctgcaacaggatgacttgtgctactcactgtaccttgctgggtctcagttttcctgtctccaaaacacaaggaggttgaaagaaatgatctctcgggactcttctatctctgacattgtacagttccatgaatagattttattgtaattcttgctcccggctcccccaagacctttgcttctgtcaaacatcatttgctgttgtttgactttgttagattttgtatttaattagaatttatattttagctattattatgtcattatttatagagtaagtcataagcggtgcctaaattcatttatcaccccatctatattagtttcatacctgaatacttcctccgctcctttttactgttcttgctaccatgtcccaaacaacatccatttctggaggtggaatgcagtataactggaaagaatctttcagctgattgtgggattattttttgcaagaggagtgcagaagctctgcttttctaagcagtaatatcaagggccatattctgcttttaatttgcaagtagaaatcgttttgatgtcatttggttttacctgcaggtgcaggttttagtctctaggtaattccttttctcttctgcgtcaactttcccaattagtgtgtgcagcattgccttgtctttttggttaattcataagcagttcatacagatgcctcttgattcattgcaattattaatagtttctttaggcagctagtgcaaatagaaaaggtgacatttgagagggtttgttgttttaatttatttgtttcatagacagagagggagggtgaaaatgaaggctttaaagtcagggagattgaggcttgaatccttctggctctggctcctggctttgtggtccaggtcacattccttaaatctgtgatcctcaatttcctcatctgttgaatggggatgataatatcacctaactcacagaatcactggaaagattaaatgtgcactcactctctagatgttgcttatggtagtatctcaataactaataaaaacagacacacacacacacacacacacacacacacacacacacacggaaggcatagcatttaagagctgaataaaaaaagcaagaacaaaggaaagtgctgcatttgaggtatagtcagggtaggaggagcttctcagagcagccagttttagtaggcagagtttgaatctcaaaaggacctttgaaatttgggaaggactaagcaccctccactaacctgtcagtgacgttttctgcaggtagctcttgggaaggactaagcaccctccactaacctggcagtgacgttttccgcaggtagctctgctctacagaaaagagtgtttactacacatgactgataaaaataccatgtttttaaacatgtattgcccaaaccttacaataataaaggaaagccaataaaagcaaaagttccctttgattccaccattccagtccataaatcaagttcatttttatgtgttgttttttagttcttgatgatgtaacttatatctttttttcagttttgtgtttcccatttagcataaacattcttagtaacttcagctatacagttctcatttgcaaggatcacataacattctatcaggttgttttatcttaatttttaagtttcctatcatttttggacattcgagttgtttctaattgtttactgttgtaaagccgcagcgaatgtctttgcacacaagtatttaccgaggacacactcacatcagaaggctcaatactaagttagagggagcttgctctgaattgctttctaaaaggctgtaccaatttacattgttactaatgatataagaatgtctctagcttcaatcttaataattgtgggacttactattttttggctaatttaataggctctttggttttaaagttttcattcctttgatccctctcagagatggaacatttccatctgtgtttatttactaattgttctttttacaattagcaaatggaagtcttgatgttttctaatctatgtatatgagctctttatatgttctagatattaatccatttaaaaagtcctatttgctacagctacttccctagtccagtgtcctttcatttcagtgatgatgctttttgttgtacaacggttcaagtttttatatgatcagcctctcttttcttctacttgtacccagggccaacctggcaggaataaatgagattaccgcagctcaaattctgcaccaggctggcgagtggtccactggatggctttgctgggaatagctctttctttcttctgctcacttttccccttgggaactgtttcctgttgaagtcccagtctttctatttccaagggcccctttccccttctcccacctgcccctcactccttgattctcacccaccctgtgccggtttcctggctgtggcatcctctctgcccagttctcaaccctccgttgctgacctgtgtgtttctcagggagccctgtcctgggagcagtgggtagaaacatgtctggcagcctccctgactagggcctagagagatcagtcaggaatctcaggcctggccaaagtctaaccattatccaagtctctggggtcggggtctttacaacttctgtcttacatttctgctacgtagcaggctgccctgctaaggaatgggctccttggcgctggttttcatccatgtaggaaccagagaggcacgatgctaccctgattcctttcctgttgtagctcttctccggggatagctcttccagtggaaggttgggaacaacttcctagggattgaattttttgaggaaggctggtctcaaagtgtgagttttagctgagtggctctgctgagctggggtggtttggcatatgatatacctcctaaatggcctgtctagatgtattgttgttctggtccaacatgtttttcctctttgaagccaaaatgaacatttgttagtatttgaaatctgctgacatctctgtttttcttaactccctccctgggttctcatggtcctcaggataaagtctagaatccttagcctggctccataggttttgaggaccttccttatctctccagcctcatcactcacatgttgccctgtattcgtcccacgtcggtcccatcgcacttcctccttcaagtgccatactctgttttttgctccagcctttagacatgttgttcttcctccttagaacccagctcctctctctgcactgtctggctacctttccctcattcttgaaatctcagcttagagtctcttcctcacgaagcccttggactagggactatgttatttgctaccttttctgggttcccatagcaccccattcttccccttgtataatacttcacaacccctttcctggcccagcgataggagggactgccctctttccagtatgtggcatctagtgaatgggcaatacatacgggcattccccctgtgatgcttatgttacaaattggatgtgattccatctattaatatggactgtgatgtatataattgtggtgtgtataattgtggtcaggaaccagcatggggtcctgtgaaccacagtggtggaaaaagctatggcacctgtttgttccactggctttgtgctttgtccatcacacagtgagtgaaaaggtgacaaaaatgtgtaagaagcctgtgctaaggagaaagaaaggtccaatgatgaattttctggaaagaaagctgtacgtaatagagtgctgaattcgctcaatcatatttaagttttatagtactgcacttataaccacacaaaacactattattattgaaattcaatacaggaaaaatgcttttgtttttgaacgtctaagactgtcttcctcctcattgaaaaaattcctactgaatttcgattatatgaagatttttagaaatgcagctattgcatcgaatgaataaatgaatttgaggttcacgttcttaacatctgttttctgactttgatcagtctcctttaagtgctctcgtggtcatactctgcaactcaggtgaaagtttctagtgagatagttatcccaaggagatacttttatctggaagagagtagttctgaagttctaagtgaggttggttggttagatttaggttaaggtaccacatggaaaggagaactgcttaaaggggtagggtgaccatgaaaccttcttctgcaaaccctgctcgtcaagtatgaaaccggtggggtaggaggtccatctaatcttatctgtgcccttttgagttggccggccgggtgaccatccatctcctctgggttgtaaatgacttcatctcgaagttgcactgttggtggtaggtgaggacgccttctccaggtggagggagtgcatttgtggttgatggtgtgagcgaccatatgttggaccatatgtcagaacctgttaagagattctgacaggtatggaaatgcctcccattggaaactgaagccctgggtcctttgaccgctgcagcacccccagaggagagtaccctaaggcccttttaaccttgccctgccctggcaggttccaaggggaggcagaaatgactctggatgaattttgttttgattattcttccccttttccaggctctgtgtccagttcacctctggagctgcctgggtcactgcaacccagactagagagaagtatgaccccaagttgtggcttttattgggagacagccttcatctaaggaagtgggaaagaatgtgttccccagctgctgcctttctggtgtctgatctgatacttttcaaaagatagcagttttgtttggtttgatttggattttttttttcttttgtaagtggtcatagacccataagacaagtttattattgtattgacagaagaaaaaaatgccatggttatttatttaaaaatctctttccatacaactttgctttctattgagtttgaaggaaatatggtgatggcatctaagcccaaatttcggtgttttattttggctttcctgttctgtttaagcctctgtaaccccttgaacctttctctactcttcagaaggaacaagttatattttttttccatctcaacatcgtccaaatgaaccgtactattttaacaatctgtgtaaacagatataaaaggaggaagactactttctttaattttcctcccagcgagctgcaaagctgtttcagtcatcctagtgattagcagaatgtgagtaataaacaacattaaaatgaagaaacgtctttctgagtaggaccttgaaatgtgggtctcaccagtagtatatgagccttcctcagactaaactccatgacacagttcatatcatctttaagtcctggagggagggttttttaatatgtgtaaatgaccaaacacagctgttggctgtcctgctgtacagagaacattcggtgacctgaaatcgcaaagtttctgtctctgaagggtgcacttaatttaactttttgccctgaagtctcaagaaatgagacttcctttaaaaaaagtgttcttaaaactttctcattttaaatgtccagggtcttcaaagagtatactgggaggaaagtcctgtgtttcctgtttctcttgtaggactagtcaaaagtaccctttctcttgatggtattctgcagtctgagcctctgatttagtaactacagcctttaaaaccacagttatccagaccatgtgcagtggttaatgtgtcatgagtctgcctcagctgataatagcacatcacagaattcagagtgccttagataaattgtttcagtggatagtcataatgactgcttgagtagaaaagtaccctcattttctaggggagaaaacagaacctacgaggttgactgatttactagattccagtggttagaaatacatgtagcctgtgctgtaaacctgattttctgacttgtagttcagctctcttctccatctccttgtacagccaagataccccagaaattatttgcgtttccgaagttgtaggatgaaaagacatgtctttgcttaactgagttagccccctagaacaatattgagatggagctggaatggtgaagaaatgcaagagtccaatcccttgggtatgtgcaattcccagttaccccttgaaacagtgcttcattataaatttagatgttagaggctgggcatggtggctcatgcctcgaatcccagtgctttgggaggccaaggcggtgggatcgcctgaggctaggagttcaagaccagcctgggccacagagtgagaccctgtctctaaaaaaaataaataaataaataaaaaattatatgttagatgtttttatagtgccggagcctaaacttgatggataaacagagaatgattttcattttgcagccactgcacctttaaagttgagctttttgaggtgtatttcctttaatgcacccatgacagcaaggttgaaaacatcaggaaatcaaattgatctcatatatggaatcttgaaatttaatgtcatctgctctgagaagtccttgtggatgggaagattgtacaatcagatcatttctctgtgtaggtatctgctgtctttctactagatgttacagaagagattagaagaagctcttccagccacctgtgaatcagctttattctgctaggcaagaaggagctggtgctggacatttgtatctgcaaaaaccatgagttacttccccaataattaagtatctactgttacaacatctagtggctaatcttttagtaaaatacactgtccatctcttggtgccagaagcaataactattatgaagccttttctttctttgcagaagtagtttgctggtgaccatattgttagttgcagaaatactcagaatctgattcacatttagacttgacagaagccagattttatatctggaaacctcattagtgaaactgcaaacaagacaaaggccatctatctctctcttaggtgccctcctcaatctctttacagcttttcccccaggagtcaaggagatacagcctggcagggacttttgcttggtgatggagtagctaagaatgtttctctctaacaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaacctgttcattgtttataccttgaccatcttttctgtcttattgctgaaccatcgcttctctttctacttctcttctgggatttcatcttgctcagctaaaattctagtgtgttattctgaatattatggctggagtttcctgaccaacttcttgcatctgagtccatttcctgtgcttaaggctgctggcattccattcactgctcctagtcaaaactgaaacttctcctgctaatgagattaggccttacaacactattaatttcttcctctctatttcttgctccattgttatttctcagagatgaaaatctatttgtcattatgagattcattttggcatcacttactaaagttcccttggatttttctgttcttcatacaccctacagcttcaaactgcaacagtcatcaactggtctttgacaaattagttgtctctacacatggtttacaatattacactagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttgaaatctttatgtctcttgattttccacttacaaataacctttgctaatggctttggggagctgttcgtatgtacccgaaatgctgatgaatctatttcagtttgaagtgtggcagattaggaatttctgctctctggaaaggggatttatacctggaatatgcatcaaattcacaaacactttgcgatatacgtgcagacacatgagtgactggttttgacaggaatttaatccttcaattggatttccctttgttcttgtgagtaatcagtatctcataaaatatattcagttttggctaattgtacagctatgatacaactttaagtttctaagatgtaaattactatgtgatataaagataattcccctctagcatttttcttttgtaacagcctctttttactcctgaaaagctctttattttaaggttgatttcattctactaggagaactgttgtgttagataacaactaatgcccaataaatacactgaagggagattaggaactgttaaagaaagaacacaaagcaaatgccttaatttcgttctttcagaacgtatatatttcccaaagttgtcagttcctttatgtttctaaaaacttaccaggtaggcatattcttaatactttgataataaaattaaacactgaaatcaaagctgtagattgaacatgctcacattaagtgaaattaaggagagaggaatacatttcattattaatgtatcagtgaattctggagtttagccatgaatatcagctataatcaataacagtttgagtatttaggcagtttgtaattcatgaaatttaaatcagaagggtctttaaacatctttttgtctaatctcattttgcattcaatttaattctattttttctcagcctactatatgcagagtactatgctagcagggaaaaataatgcggaataagttgtggcccatggtttcaaacagattaatctttgattactctttgatgctttttttgtattatttgagggacagtttttttttcttttttgagatggagtctcgcactgttgcctgggctggagtgcaatggcacgatctcagctcactgcaaccttttaaaaagagttaagtggatcttcctaatgattattctttgtcaatgtaagatattaggacttaatgtattttgtgaactctgagtacacctacaggtgagtggtagatatcttcatactttaaattactgctggattttgtctgtaccccgagacagaattttggtcttctcttatatatagcagttaatattaatgaggcttccctgaaagggttcctggatattcagattcttcacacttttcttataaaccattagatttgtttcctccattcatttgggcatcttctagtgacacacggagtggctcttaaaaaagtggaacttgattgctgatagttttattcaataaatcattgttaataaatatttatttgcgatcagaaacacaaggagggagtgtacacactcagaaaagcccacaatgcagggagcctgttcttctaacaataataatggctggctggcatattgaggatttaggatgtgtcagtcactgtactaatcacttaatcctcacagtaaacctacataggtcattattatctccaccttacagatgaggtaaccgggttagtagcttgcccaaggtcacagagctagtaagtggtgggactgggcttcatgcatgccattttaaccttagaccctgtgcttttaactaattatactctattgcctaccacctgtgtcattgtagaacttgcaaaattatgttcaaaaattgtttttactaaatataaaataaaatacagtaaaatagaaatacaaaagtatattcacaaaataaatgtaaattataaaaaataagggttcagtgaacactcctttaactctacacccatattttaaaattaccatcaactggatgtcctctatgtggacctccccaatcttgtcacattcttcccacctcagaaggaaccactatagaaacatgacgttttaaaatatttttaagactaggcacggtggctcacgtctgtaatcccagcactttgagaggccaaggcaggtggattatttgaggtccatagttcgagaccagcctgaccaacatggtaaaatcctgtctttactaaaatacaaaaattagcacacgcctgtggtccccgctactcaggaggctgaggcaggagaattgcttgaacctgggaggtcgaggctgcagtgagctgagattgcaccactacactccagcctgagcgacagagtgagactccatctcaaaaaagtatacatatatttttcacgaaagtacacaaaaatgcacaccagccagatcactgtttgttttctctcctttttctcttcttttttccctactttttcatctctcatccttcttccttcttttctcgcaccatcatggagaacaaagaagaactgggtcagaacaaacctttaaaaagtgaaggcgagcgttccttgcggggatgcccagtgtcatgactagtgttgggaattcttggtgagatgacaatatttttgcctcactcaaatgaggcatgcccttccaagtaaagcatgctatgttttgtagcaaacagaacacctgagaaggatgatttcatatgactgtgccaacagatctctcacaagcttgtcaggttataattcacaaatcttaactctatagtctatagacattttttttttatatggggtctcactctgtcggttgcctaggctggagtgcagtggtgagatcttggctcactgcaatctccgcctcttgggttcaagcgattctcctgcgtcagcctccggagtggctggggtttcaccatgttggccaggctggttttgaactcctgaccacaagaaatccacctaccttggcctcccaaagtgctgagattacaggcatgagccactccacccagccagtggttctttttcatttgagatggagttttgctcttgttgcccaggctggagtgcaatggcacgatcttggctcactgtaacctctccctcccggattcaagtgattctcctgcctcagcctcccaagtagctgggattacaggcatatgccaccacacccagctaattttgtatttttagtcaagatggggtttctccatgttggtcaagctggtcttgaactcccgacctcggcctcccaaagtaccgggattataggtgtgaaccaccatgcctggcctgtttcttttttttttccaagaggtcagttctcagtctgttgtccgaactggagtgcagtggcatgatcacagctttactgcagccttgaacccttgggctcaagtgatcctcctacctcagcctcccgattagctgggactgccgctgtgcaccaccacacccaactaatttttaaaatttttttgtagagacagggtcttgctatgttgccaaagcttgtctcgaactcttggcctcaagccatcctcccgcctcggcctcccaaagtgttgggattacagacatgagctgccgtgcctggctgacttgtggttcttaatagtgtggctcttaaaatagcaaacatttttgggaaccaatgtgagggcacttcataacacaatcaaaaaccattaagtggaatatgttaagataatgtaaccttgttgttgtcccttaatgctttaatgcaggctttcagcaagtagtaatacctggtatggtgggtgtaaaactcagaatgggtcccggcatggcaggaataagagaattctttcatcggttggaaaatatgtttgaataattcactacatttaaaaaataggtaaagaggcttttggttttggttgcaaattgcactcatccatggaagtttttcaagggccatacaattctgtagatggaggtggcaatttaatgcagtcttagctgtttaggatttagaactatgttacttttaatttacttccatgaaattacaaaaacatgtaatgaagctaaaaagatttcaaaagaagcacatctagtcaaacataaaagtacttaataagggcatacatgtagaagtatattagtctttgcacatatttacatatgtatgttttggttgcttaatatttttcaagtgctgcatgcatttgtatgtgtaaatacagtgtgcaccctttatagaactagtgttgggggactcttttatcagctattatgatttggagctttatcaaatggagtgatttttttttgtgtgtgtgtgagatggagtctcactctgttacccagacttgagtggagtggtgccatctcggcttattgcaacctctgcctcctgagttcaagcaattctcctgcctcagcctccaaagtagctggaattacaggcacccattagcacgcctggttaatttttgtattttcagtagagacggggtttcaccatgttggccaggctggtctcaaactcctgacctcaagtgatccacctgcctcggcctcctaaagtgctgggattacaggcgtgagccaccacacccggccggagtgatattttccaatggtcatgattctggcctgtaacaccaagcagtataacgatgagattgaagtgtgaccatgtgcgtctgcctatttttatgttctatctcatctttttgcttggagaaaaattatgttgaaagactacagtgtgcctataaagcttcaaatatgaaaaaagagctacatatgacactttgttgcagttagtccattgtctcaaaaacatgctataaaaatatgacaactagaaaagtcttggcaaatgtagcatgagtgttgccggtttaaaagccgtgtttgagtactctaaagtacttttctgtgacagctattactataggaattggcaccagctaagaaaatttacagtttaatactttagagcaaataattgcttagggtgctttaaatagcacaggaaatgtgtagagtgtttacttgacatttgctatattgaacactaatactgaaacagattctttgaccacagagaatgccagtgtaggaggggtgggggtaggtgggagaaagaggcggagaaggaaacggcaatacaattagataaaaattaaatgacaaatgtactttttcatgatacagagatatcatggggaaaaatgcccatttgtttgatcaagtaatcttctagtgtggtagcagaaagcaaagtacagacaacttcctgggattaggttcctcctgctaaaggctgtcttcaccagaaggtcaaagccttgcagcccttggtcgctctggtttatttttcaagctcctgaaagcaagaggaatgacctccgtttttattaaaaaaaaaaaaaaaaaaaaaaaaaaaaagaaaagaaaaaaaaagcctctctcgttatctgtctaatctgcacatgcttgtgatttttttttatgacgactctgatgccctcatttctcattgcagctcagtgcttgtgatgtttttttcccctgaatgcatcttgcactcccagaatcttcttttcattcttccctggctctgttaatacgggtcttatcttagaacggggtctagtgcagtttagtgtagctcttacatgcagagcattttttttttgcacaaactgcttctcgtggattgtgattcagttgcacttaaagggaaaaatagagtatattttaggctactaaacctccttccatttgtaggcatttgagccagttatacagtgtctttcagggagttttacatgcatatgttaataaccagtggcacctgtgataggtccaggaatgtgaaattgtgcaacgttaatgacatttgtccaagcttcttccttctatcttgtcaatatgagctacttttaaatacacaaaggaattttgaaaacaccaatcaaaagtcaaaatttcaccctgcagcatggcccggcacccagaacactcagcaagaggaaggtctgtatttatggcttttccactgacttgaaatttgacctggaataaatcatgtttaacttctttatgcttcaattagcttttgaaagatatgtgtggttgtgtttagccagtggaaaggcaataactgaagttcacaacgaaaggagaacttgaagggaaattttgttaggaaagaacagtgggcaagaatacaatcttcaggcagggtgctattcctaaaaagtcttggtacacatggttcctaaggaaggtgggacattttcttataatattctttctgtattttgtagaattaagaaatatattattgtacataaatattttatattacattatatatgtataaatacatttatatatatatatatatatacatactgttttaccctttaactccagaaagctttgcgttcacacatctttttccctaacttctacctataaagggatttttagtgataatcttgaatttaaattgtaatcaagcagtaacaaacttcatttaatatgcagacatctaattttataaaggaaattccaagttattgttcatttccatttattaatttatttattttgggacggagcctcactcactctgttgcccaggctggggtgcaatggcacaatctcacgtcactgtaatgtccatctcccgggttcaggtgattctcctgccccagcctcctgagtagctgtacaggcgtgcaccaccatgcccgactaatttttgtatttttagtagagattgggtttcaccgtgttggtcaggctggtcttgaactcctgacctcaagtgatctgcctgcctcagcctcccaaattgctgggattacaggcgtgcgccatcgcgcttggccaatttttgaagtttctttttttaatctgttgccatctctgagatgagaggtttttcattcatttggggaaaaaggaagaaaggtaatcaacatttattgagcacctactgtgtgccaaacagactgctaagcacttagtccttaagtaccctacgtgactgatgttcagagggccattttctctgtgtcaggaatcaggtgggagggccagaatccatagaacaaaaatataaccgttgcaatagataattaaaaagagggaccttttagttagtggcacccaaagcatcatagtgtgggctgtgagatctcagtaaaccagttgttggtaggttcccccaactcagagacctccatgagggttggatggctggattgcaacatggtgctaaaccacatctccctggttaagccatttcagttattgcctcatttaagttgcattgctgtaaaagacataggtatgacaagttgcaatgcctaaaattcgaacgaaagaatacaggctttgaatgttattcagagcttgactccggagtcccagatgcagtttcagggtgagtaaatacaaagccagcagctcccaagtttagatgagaaaacatttcaaagaaagccagcgaacgcttatatatttaacacaatatccatgactcattttctctttgctctctcagtccagccgttattcatttaccgctcaccccacaggaaagctccttttgaagtctgcctttggctactttgcaaaacatataaatatacaccttgggagaataagggtgagagagaaaaaaggcagaggtcataatttttaatcctggttctgccaataacaaactttgtgaccagatactttgtacagtaaaggaggatgtttttaaaacccattctcagttgccagagaggcaggcagtcatcattctgtaggaagacttgtttcaggatttctcagatgtctgctgtgtttggattgctgaggtccctaaagaaccttccctttgagtcagctcgactaggcttttggaagtagccctggaggtgtgatagcaccttaaaaattcttagtaactaggaataaatagaaggagaatgggaaggaatagaagctgggtgacggggaagggaatgccaagctgtcctgcagctgggatccacacttggtgaaggttgtgcctgcgtccctcatctgtggttgggtataccagaattttgatatctctctagttcgaataccagccttgacatttaccaccttggccaagtccctgaacctatctgtgcctcagtttcttcatctgaagagtggggattatagtcaatgtaaggactaagaaaatcaatatacgtaatacccctagtattcacacttcacctgctatgatgatattaccattctcctttggagttttctaacttatttgtgtagcatttagggcaaaataccaggcatatgggtgatggcgtgtagtggagttggtgagagggagaccttgagttgtagaaagggtgggcagaacctggtttctgtcctacatcccagatgttgcccatacatatcctgtttgtttctgaccaccctgctttgctgtgagggttcccagcccctctgcctttacctgtcctcattctgccccactgtccatgcccagcatgaatctccacttctccgggacggaaagttttccccagctgcttcagcccaaaccaacttccctccccactgccctgtgcgcacagcttatttgatcatgtcatttattgcttcattttgtggcttagatgtcttgcgtcccagtcagactccatgtgactggaggcctttgcctcctttcagctccagggtagtgtggcagaaagagcaaggagcagggagggaagggacctgctctcttctccagccctttctctgtgataaactcagcatgctccaggcgtttaatctctgtaatcctcacagcctcctcatgcaaaatgagggtctagaccaagtgacctctacagctgcccttgcagcttccccattttagagtagtagatggtgaataagtatggcccgaatgaatgaacaaatgtgcagtctcaagttggtcagttgtggcttaaattatttttgtgcccactggcatctcggcttggtaaatggaggaaacggtctctgacgaattttcactttcagtagacagaaattttgttaattttgatcattttatagtccgaatttgtggacacattgaattaatatttatattagtaatatgtctaagaagaaaagattttttatgctaacaaataatataaataatgtcacagactaataacagctaagagtcagtaataaaggaaatttgtttttaagcactttggaagttcctgtttgcatgcattatatgattatatatacataatttgtattacattattatataagctctcttagtctattcattaagtaatttgatgatcattttgaaatttttttataagtacttaagagagttaaaactatatttcttcttgaaacattgtaatttggacttgttttcttattcatattagatgtcttctctgagcccagttactgagtatgtagtaacttttttgtgtgttacaataattgacagagacggtggttcaaattttcagcatcaaacctcactttggaattatttatttccattttttctcttacctactagtatatatggatccaaaattaattgcttttttattatatttaatacatctatttgctttgtggttttactgatacttgaaaattgtaaacaattatgaaagattttgaactttaatcatcttaatttgcttaattaacataatttactagaggagagaaagagaaaacagacttggttacttatttatgtttgtaaccacctttgtatatgtagtaacaccagagcaggcacttcataattgaaaaggctttagggtaataagtcactgtctgtttcaaactgtgatgactttctggaaaaaatagcttttgtaatatttgtcatactggcccagatccagaaagtagtatgttcagtgtctaattgtactccatatggcctgaactcttgagcaatccatctgaagtaggaccctgttaagaaattattctttgtttttttttgagatgaagtttcgctcttgtcgcccaggctggagtgcaatggcatgatcttggctcactgcaacctccacctcccggcttcaagcgattcttctgcctcagcctcctgagtagagtagctgggattacaggcacccagctgttttttgtctttttagtagagatggagtttcaccgtgttggccaggctagtcttgaactcctgacctcaagtgatccacccgcctcggcctcccaaagtgctgggactataggtgtgagctaccgggcccggccaagaaattattctatgtcatacataattgggtgcaagaggtcttagtaatttgcattttaaaatgataattggtatcatctacgaagagaagttctaccttagtgttttagtttagcagtgacactaagatattatacatatgaaaatctcttaatgttagtgggcagaactgggaacccttccctttttttttttttttttgagacagagtcttgctctgccacccagactggagtgcagtgatgcaatcttgactcactgcagcctctgctcccccgggttccagcgattctcttgcctcagccacctgtgtagctgggattacaggcacacgccaccacgcccagctaatttttgtattttagtagagatggggttttgccatgttggccaggctggtcttgaactcctgacctcaggtgatccgcctgccttggcctcccaaagtgctgggattacaggcatgagccactgtgcccggctggaacccctccctcttacagttcacagggtataagaagctactttctagggcttcatcttaatatggtgattgagttctatattatggccaaaaggaaaattatgtgggtattgtggggaggaggagtcagagggctaggggcaaagcgggcagagaaatatcagctgcctttatttagcaaatatttaccagtcgttcctgcccatatgcacttgttccttgtgtacttggatctgaattgattaaaaaggtctgtatgtattgagtcttttcccttaggagcgcttaagctttcttttgatgctttttttctcttcctttaaaatggtgcaggaaaatgttggaataaacatagtcagcttgtgaaaggatgattctctcccttatctgggcataaatattgttgaatgtgagaatgtgggagtagctactgggccaaatatgcacaatgagtgcaagtgattattgaccttactgatgagaggaaggaagagaaatactttaaaactattttcacagggcatttcaaccaagatgtttttctaaattcggtttctgattcaaaaactggatttagctctttttcttgtttgtttcatctgaacaaatttaccctgaattgaatgggagagtgtttcttaatcccccatgtctttagcagtgagtcatttccatgttgttgagacattttctagcctttattgctgtgtgtagttcatgcttttctctggatgttttgactccttaaggaactcgcaataacaaattaacaatcacactcctctggaatgaaaacacgcagtatcggagtaataaatagcagttctcgaaacctaaataaacacagaaaactcagctctcgtacttaagaaggctctagaggagtccagtgtccaacattacaagcaagacacaccatttaaagccataggaagttaacatactttcattttaattttccaagggatcatgttataaaaccatatagccacttccattcttcaaaacttaataaacggttagttttagtcatctgacctgccttctctcaaatggatcataatttagtttaacaggtttgacattaaaataagttgtgtttctctgggaaactcatgttagcctggacttctccacttcctgtctttctctggtgaagctggtaatagtgactgagctcaggccatggcgggatcctcacagccctaagactaggtgccacctgtgtgctgcaacccagtaccaaaataacaggaaaaatctaaagttatccagataaaatatgtcaaattataaagcctctgagtcatgacagtaatcaaacctgattctatatcagcaatcaaacctgactctatatcagctttaccaaacactattaatatatcctataataaaaattaaggcgtcattcctcaggttctttagcaagtaagtcagtgcatctatctaatttgctaaggctgaaacctattgtacatagaactcgggtctgaatggttgtcccgtagaaagttttagagcagagcaaggttgtaaatagccagctccagtggctgtttttcaccctgttcatgggttgcttgccctggttgtatatttagttgcctgtgatggatggagtgaagtgcacaggtcgtctctcaggggtgaacactgggtttgattagaggccattgtcatgaaagatactccagctcttccatgaccatacatgcttagaagaaaactttgatgcacaaagaactgaaagccctaggcactggaattcctgctcatcaaaaagacacctaaaaaattcttttggagacttcatgaattttctctcgattcatactgaaggactggtgccagtaatatttttcctctttgcctgtttcagtttctcatgaagtttttccatatttagacacactgcccagttaaagggaatgccagtcactcggggtttaagacaatgaagtatgtacttccctcaccaatcagttgggagagctgattgggctgaacttccagtctgaggcatgtgagtcacacacaggcagagatttaaatgttattaacatgagaaagatcttttgaacgtgaagtcatcatgcttgaggttactttgaactttcctcatagtctcttttatgatttgtgtaagaatcaacatgctttagtcttatgttaaaaaaacacagtcgagtgaaaatggacatgaatttaaaattgcatgatagccagaaacttttcatactgtggaaatgttacactgtgataaacatttagtgaagctgcttggctcatgggctatttttttaatggcttttgggttcagaaatttcaaaatgtcagattctttgtaatttaaatttccttctaagtaaggaagtgcactatgttattaattttaaaaatatatatacttagaagttgaaattgtgtaattatcttaatgctccagagtctcttttctgactaaacattggaacttattctgttgaatgcagggaatttgtccagaaaagcttaaggaaatttagcctacgaggggaaatgcgctagattcataaataaaaggtttatccaaaggggtgatatagaacatgattttatctataaaagattgtacttgagttttgtctcttcctcctccttttaggattaagtaatgattgtagcttagtttttatagttgatttatagtaataagttatgtgtaagctgactgtgggtagttgaactcatttcaactgcagaaggatagattgttgtttaaaggatcatacaaaaattattattttttaataaaatgaaaatgtccccagagatgttacacctggaaacttaaaagtaggaaaaatgataatatagtatgttactctatctctggaaggaatgatctctcccactgaaaagtaaatagtccaaagtttacaatgtttagttgaaatagcttataaatcacggcagtgacttttaatccttagtagaattctcctttatttctgagaagtctgtataaatgtttatggaaacacagtctgaaatattttaaatgtagcataccaatagtacttaaagagaactttacgcatgatcacacacattcagagttgttgggtaaaaacaccttgtaccttctttggtagaaaatacttctgtatttgcgtgtgtgtgagagagagtgtgtgtgtgttttaaattcttaaacataacagatcttttgaagcagagcagaaaactcgcatgttactgacactgcattctcagccatggggaaagcaacagtgtgtttcagctttagcaaattacatgtgttgactcactaaagaacctgagtaactacacctcagtttttattacaggaaatattaatagtgttttgtaaagccaatagagactcaggtttgattactatcatgactcagagactttataatttgacatattttctctggataattgtagatgtttcctgttattttggattttttattatcgttatttactgtgagttttgcgctcatatacatgtagcccagaaaagcgatagtgagatggttcagtgtatggaatcagttttattgaacaaacagtggggcaggtggggggagatacttttttgtaattagactattattagtgagcacttcctttggcttttgttcatttaaatgtatcttttctttataacttcacaggacgtggaacatgtaaatgcattttgagttgaaagcagaaaatcacatttcagtaaaattaaaagctcaagatttcattttcttgtaaaatttctaatcatccccatttgctgaactttgggccctttcttggcattgggaggtcatggctaatgaatgcatctcctgttgcctggcttacagccgccccctgctgcagtgccatttgggagaagtgtgtaatgtgcgtgcttggactcgttatctcctttcatttcctcaacatcagttaatgctgcatagtttgcaacatgatattgctttgagttggtgcctaattgtgtaggctggctagaagaacgaatctttgcagtggtcaggtgaggccactgagtgtgcccctttgcggccactgcaataaggtggttgggaattcttcatttctgatcactgaacttttccagaacgtcccaaggctcccccaggaactgtattacagcatgacattctgtgtatgtgggtttttctgggagaggattgtagctttcaatcagatcctccaagaattctgtttctcaaaaggttcataggaaccatttatttagaattgaaagataggcacatcttctgaggaaaacaaatgaaaggcttaacaaaatgttaaggctgagttacagaaaacaagccataagctacctattttattcaattaaaaataaccatgacatggccattttgtaaattattacattaaatctgcattgcagacatacctggtacgtatttatttatttattttttaagaggcagggtctccctctatcaccctggctggagtgcagtggcatgatcatagctcactgcagcctcaaatacccgggctcaagcagtcctcttgttccagcctcccgaatatctagaactacaaggacgtgccaccatagctggctcattttcaaattttttgtagagacgaggtctcactatgttgcccaggctggtctcgaactccctggcctcaagcagtcctcccacctcagcctcccaaagtgctgggattataggcatgaacaaccacccccagccacttggtacatatttcaaatgtggtttgtttcttttgaaataatgaaaaggaataatgtttcagggtttgtggcatccacattttgggatggctacatgccgtaaccttgttcgtagtagctcctgatttttatctgtattagaaattgctcggcatgagacaaatgaggaacatttggggaaatgtgtgagtaattgagtaaaaactaatagctgtcttaagggaaccatcttctggtttgcatttgtattaataggtatgcagagcaggaataatttggaacgggggagctggttatcctctgggtgtgtcaagcacaaatctcagattccattacatctgcacaagtcttgacagtttgcaaaatgtgcctagaggtatgcttgataaggacagacatttcttgcctgggttctaactgtgtcactgctagcacagtatctggcctgaacagcatctaaagaaatattttgctggatgggttacctcaatgggttctcatagcagccctgtggatatagacacagcatgttttatcattcttttctacaggctcaaagagggtaattacttactcaggctcacatagctggtaggaaaaggatttaggcctctcctttataccatgctttagctcgacccaaataataaaagcaaaaaagccatgtttggatcaactgagttttaatagaagagcattggagagaggttgtaaaccctcagatattttcaaaaataatagtaagcattcttgacttgcaatgcagagaatgtcttaagctcatatgtcttgatggtgctaatcaagtcaggcttttataattgagtgaaagcacagaaaaataatttattcattcttatacaaccaagtatttattgaatgtcttttctgcaccagacatggttgtatgcactgaggacgtaacagagaacaaacaaggttgtctaagtccctgccctcagagagcttatgttctcatagtggagacaaccacaagtaaattgcataagtagactctatttgcagaccccccaaaatagagtaggatatgttaggagaaagagtgatggcaggggcgaaggggattcttttgtttggtggagtcagggaaagtcttaggggatgggcttttgtacagagactgcagtaaggtataggagccagccctggaagatgggagtggtgaagggtgagatgagaatctgaggatgagcactgtaaaggaagagaatggccaggtgaaggctctgaggccagaaggagcctttgaattgatctagaggctgcaggagcttggattttacgctaaatgtgatgggaaactctgttagttttccagggctgctctaataaattaccagaaacttggtgggttaaaacaacaggaatttgttctctcaaagttctggagggcagacgtctgaaatcaggtgtcagccgggccacactccctcccgaagctctgttgggagaacctttccttgccgctgtcatcctctggtggttccaggcgttccttggcttgtggcagcgtcactccagtctctgcctctgttttcacatggccttctcctctgtgtctgtaccaggtcctctcctgtctcttagaagaacagtggtcattggatttaggacccacccgggaaatccatgacatttatgtcaggggctggaaaaggaaggacaggtgggatgtgaccatccggagagcctatctcagctgtcatgggttgtcacaaaggccattgtgtggttaatttttatcttcttattcttgtttcctctttaatctttcattctaagccctatagccctgactggcagattcgctgtcgggtttttctagttgtagatgacatgctttttcttaaagccatcttcatttattaatctacattcgtttttaattttaatgcaccaatcaataattatttcacttgacagtttttgacagcatgctgcttgcgacatttagctgtttagcatgaattcaaaaggtgatctatcaatttgcacaaatgaaataaagttgctctttcttcctgtgctttgggggaatgtataaaaaaatgtatgtttatccttccctggagaatttttgatgtagaaatactgaatagttttctatataagaagacagaggactaaagagctttaaaatttgttgtgcttattttgcttgtatcataaattcacgtgaaaggccagatttctcttaattgcgttgatattgtggagatgaatcattcaacaaatgtttattaagtgctcattgtgtgcatggcactctgcaaatgttatgggaaataaagacagagtccccgggaaataaagacagagtccccaggaagtctagtagtcagagaaacaaagccacttcccaaattatggtgggtagaaaaacttaggaaatgacagttttatcatgctacataccttcacttaatgaatcctatgtgaaaattcccagtaaaaacctatgaacaaaagtgtgtggttgtcttcatgtatacattgtgtgcacacatctgtgcgtacaatgcacagctttgtatgaagctagctgaaaactaaacagctaggctgaacttagctgaaaactaaacagcaggggaaatgttctttctcactaaaatcacagtgttaaaactcttggcagttcagatggtctccactgtagctgttggtttacattttgataatttaccaaagagcataatatatttaattcctagttggatggtgtaactcaacacagcatttccagcgaaacgctttgcaaatgggaagtaagcattttctttggaaaccagcagcttccttactcccttggttcttctgtgggtataagcatgacctataggttagaagttctggaacagaaggagaaaaatgaattatgtcacagttaacaggaaaggaggtgctttgcattcttgctccgttgcagttagttttgttttccttccttggtttgggggcatttggccttgcatatcctggcaagatttaggcaaaacaggcactgaccttctttctggaatgctctttcattttgccccatgcatattattaagaggcataattcactgtcatatttttgtggctaaaagttttctaacttctatacactgagcctttgttttctgcttaatagggcaaaagagctggcattttctgggcatcattgacccttcactatgatttagattttttaaagaaacacataaactgttcattgcaccttgttgtgtggcaactctgccagtcactaattggtactgtggatatttggctgttgctcttatttactttcctctggtttttacatcacttaattaaatcttgtgccagtttccattctatacatgtatagggaagcaaacagaaactttgtcctgaagcaccaggttctttggcttcatcatcctaaacagctctgtgaaaatcagttgaaagtgagtagagccagaagtggcgtgtaagccatgctgtcagcgagggctggctggatctgcatacgatcgccgccttctgcccctgcttttggagactagagatggcttctggtctgtgtccagggcttgccatgctgattcagagagctatgccacagatgagcctgagttgagaccatgatgccagcatatcctcagacccacgagatcgttatgccagaatgttaatccgcagtggaaaccattactaacatactctcaaggcccacatgatgagcacattctctctctgtgttaagctgcatgggaatgtaaatcctaactggaagctactttattgatgtgccttgagaaattgctgctctctggctgcaggtatcagcagcagtcacagtgcacatgctctctaaggaagatccatatggagtcaggtgtttgcttggtgagcagggaatcggaacaagggagtgggatgagttgactgttaagtggcaccaagcaaacatagcctgcctctctgttcatctcaggagaagggtggcttttctagtgggaccaggaacatgtcagtcattgcctgctactccctacagtcatctcactagggtggccttgcctgtgaagacactgtattctccccaacaaccttggcattgcctacatagactttagtgactctgtactttcctggctaagccagccctggcgcccttttgaggacacagtcttttcttaaattcatgactatatttcatcaggtgctggctggggcaggggtagtggtgatggtagtaattatctttcttcagttggctttgtatgtccatgttctcatccactaaattttgttcttactataaaccgctaactaggcaatctcttccccgttgtcaagttcttggttggggaatggtaatctttattgtccttcttataagtccctttggaatggatagaggctttgggatggacatctcgtgaactgtatcttcatatcaagctctgtgaactgaatggcaacaaggaggcattcatccagaccaggagtaggcaaactatggtccatgggccaaatccagcctgttcttgtaaataaagttttattagcacatagctacatccaataatttgtctaatgtctatagcagtttttgcactacactggcagaatttgatttgagtcatggtgaaagagaccatagtccaagaaagcctgaaatatctactatctgatcctcatcagaaaatgtttgccaactgtagtctatacctttgcacgtcagagaattgcatcagggaagaactagaagccctccttttgcacccccacaaccctgccacaattcagtgaacaaacagaagatcagagagggaatgtgacttgaccaaagtcacacagctggttcataggaaagccaggacctgagctcagatcttccagttcctagtgtatttgtcttctacttttggaggacgttgtgagttttctggtttacagatgattaaccattacaacatactgaaagaaagcttctttagtggtcagagctattttccaaactgacttccccaggcaaaatcactagccagcttggcattgatactcatttattaatcttacaaacagtacctaccatatttcagggatggggctggggctaagacactgatgaagaagcacaatccctgcccttgggaagtttggatgagaagagtggtcagatagctagatacagagatgcatgtcattttatctgtagtgtgttacttatcatcataggactgtgatcatatggacgaaggatgcgttaatttagccttgagtgggtgggggtgttgtcaggaatggctccatagggttggagatgtttgagctctgtctcaaaggagattgagttcttcaggtagagaattgcagcagaaatggctgtggtcctctaggcttgagtgtgcatggtatccagtaatttgggaatgcttgtctaacacaactagaggtagggcttaggggacgtggtatggggttacaggaaatctagttggaaaagtaagttggagccaaactgggaaacttacggcatttcaaatgctaaggagtatggactttggcttatattctaggggttttctaatctgtagattccaaaacatatgggagaccacatttcttgtaaaagaggacctgcacattcataccaacacaaagcatggtctgtagatttggtcatcagaatcactaacagaaataggagctttcttccaaatatatgtagctggctgatattgtaagtcattagccagaattcattcacagcgttactaagttcatagtatctttttgaccattgtacatcttcttgatcaacagatattaagagttaaacatctagtgcctgaagtctgcaacatttttgattgaagaaaatgttgggaaccactgccgttgatggcagtagtcatgaaattttttgaattaacacatgttataggttccagagtcagctgccctaaattttactagctttgtgactttgagcaagttatttaacatacctcagctgtaagagtctttatctctaacgttaaaataatagcctctgtctcttaagattgttataaagatatgataatgtctgaacgcatgtagcatggggccaggctgatgggatatactcatgtttaaatagaagctattgtaatgatttttagcggatgtggcatatgcagatgtattttagatttgacccagtgtggacgatgagttcaaaagggagagttgtacgaccttcctgttatccaagtgagaaataatggggccagggtgggcaggggataggttagggaaggagaggggagagggagtatgggaaggtgtatgtccactttaggtaatgaagtgagaaatgaaagaagccacattctgtttcatgcccaaagcaacagacaaggcacaaattagagtgtagggaagccagtttctgtgacttgatggcatagaatggtgtggcttatctggcaaattccacgccccgtaactcctggaattgatctggataagaattcaccttgagtaaattttaaaaattaatttaataaattaatagccccccctttgaaacacagaaaaattagaattacagcatgagtatctttttttgctctaaaacagtacagcccagcagttcagcctacacccatcacagagctttcaaaggaatgtatacaagaaaatacatatacaattacaaattttaaaaattaagtaacatgtatatactgttaaatatttatatattgatgcttagaaaaagatgggacaaatgttaagtgtcagctgggaggtttttactttcttctttgccatttctgtatttttcaaaatgaatatgtatataattttaaaatgtgttaacactatttcaaaaggaaaacaatcacaaaaaggaatagattggaaaagcttcaggggacttgctatccttgtctttttgggtagctgttctacaaaggcgggtggtggtgggtgcctcccagctgtgtctcatttcagtcagcggatgctctgctaaatctagtgatgggcggcctacctccgaaaggtgggtgggagtgagggatgagtgtagcagtagtacatgcaaatggggccaggttttggtgtgtgtgtgtgtgtgtgtgtgtgtgtgtgtgtgtgtgtgtgtggtgtgtggttttttttttctttctttttttctacagtcttactctgtcgcccaggctggcatggagtggtgtgatcttggctcactgcaacctccgcctcctgggttcaagtgattctctgcctcaacctcccaagtagctgggactagaggtgcacaccaccacgcctggctaatttttgtatttttataaagacgagatttcacatgttggccaggctggtctcaaacttctggcctcatgtgatccacccgctttggcctcccaaagtactgggattataggcatgagttactacgcgcggccagggaccagttaagatttgacgattacattttattgaatgtttgcatcagaggcacctggaaggcttgtttagaccacagatttctgggcgccaggcccaggggttctgatttaatagttctagggtggagcctgagaatatgtatttctgacaaatccctccgtgaaactgatgctgctggccccaggaccacactttaagtgaggggtagtaagcgggtggagaactgcatggaggatgaaaagcatccagttggattttatatttgctcccccttcttcatatacacacactgaaatcactccactctatgttttctcagattctttccctgtctggaatatttggttctctcttcatgttcagtcagtagaaacaagaagtaactcttggattgagcagttttcacacaagtagcccaaatgatattgacacatcatttctacacagcatcagcttgttcacacacatacgcccccagaggccaatggcgtcctttggctttgttctcctttttaaaaattcagtgagtaagctaattttataggaatgtctcagaaagctattcctgtaaacccagcgtttgtaaattgaaatagaggaagcggtgctgattaccgcaattgtattgaaacttattcatggagcggtccctctagattcagatagtttggacagaaaccctccaactcttcccttaccactccattgtttggtaaagtttaatgtgctcacatggcatctactttttcagccagggttaatactcctagcgattctttcactggaagggatgactcagagaggaagagttggcattaattgcttcatcaactatgcttattatgagtcatctcttgcttgtcttagtaattcagctggaaaaaggagaaatgttatctctggttcctgaggccagcttgggcttcagtgaactaggatactccctcgtagccatttgtgagtttcattcagttactaagggaatgaacagattgtgaatctcattatcctagcaggtacatataaatctataaatggcgaatggcagttacttcctgatgtttatcagtgatgagatgccacaggcaggacgttagccctagaaaggcactgttttgaaggtggctgattaaggggcaaaagaaaaaaaaaaaaagcaaaaacggagggatatgttcaggtccctgcctttactcagttccctcccctagcttccaatttgattaacagaggtgtcgagggaggaagagaacaatttccaaataaaactgcctttggttctttttttgagtgtaatgtggtaactggattatttggaaacacgaatttaggtctcttactttctacttcttgcgttcagttcactcgtgtcttcctgtttggtgtataccttccccttctgactcagtcttctctatttctcttctcactgtagcagaccaccgttcttcccctgccttaggcgtttctcacttgctgtctgccttgcgtggctgttttcactcaagcatgttcactgttcctttgtacggaataggggttatccccacagaccctccaggtagaaagtacatctttcttttcactaataaattagtttattattaatagtgaaaagaaagtacatctttcttttcactaataaattagtttctatttagggagaacatacagtgaaatcaacacatcttaagcgtacagcgcaatgagttttgatgaatgcatacatccacataatcagcatcctaatcaagatatgggacatttccatcaccccagagcccctctgcccccttcctgtcaactttccacctccccgtcatcaaccactgctttgatttctgtcactgtaattgaattttgtttgttcttgagcttcatacaaatggaatcagtcagtactttttcgtatctgctttcttttgttcagcatatcatttttgagatcatctgtattgttgcaggtagcaacagttaatttaaaaaatgctagccagaggccaaggcaggcatattgcttgagtctagaagttcgagatcagcctgggcaacatggtgaaaccctgtctctattaaaaatacaaaaactaggcggcagcagtggcacgcacctgtaatcccagatactcaggaggctgaggtgggaggatcacttgagcctgggaggggtcaagcctgcagtgagtcatgatggtgccactgcacttccagcctgggcaacagaatgatgtgtcgcaaaacaaacaatctatatctatatagatatagatggtttttttttttattttgtgaacttacatatatgtgtgtatatatatatgtgtatatatatgtgtatatatatgagttctttatatagtctggatttaagtcatttatcagaaatatgaattttttctcagtgtttggcttacctttttcattttttaaactgtgtttgatgagcccctttaaattttaatgaagtctaatttatcattttttaagatatatgctttttgtgtctttataacatttttgcttaccctgtggttgctaagatgttatcctcctgttttctcctggaagatttctagtttagccttaacatttaagtatatgagccatttcaaattaagatatgaggtgtaggggtcaagattcagtttttattaaaatgtatgaaacaacaattattgaagtgattttttttccttatgaaattgccatcacacctttgtcaaaaatcatttggttttatatgtgttttaagactctctgttccactgatctgcagtctgtacttaggtcaatactatattgtcttgattaaaatactgtcatgggctgggctctatggctcttgcctgtaatcccagcaccttgggaggctgaggtgggaggatcgcttgggcccaggagtttgaggctacagtgactgcagcattgcattccatcctgggcagcagagtgagaccgtgtctctattaaaaataataataataggctgggtgtggtggctcatgcctgtaatcccagtactttgggaggccgaggcagaaagattgcttgagctcaggagtttgagaccagcctgggcagcatagcaaaaccccatctctactaaaaatacaaaaatcagctgggtgaggtggcatgtgcctgtagtcccatctactggtgaggctgaggtgggaggatcgcttgagcccaggaggttgaggctacagtgagctgtgatcatgccactgcactccggcctgggtgactgagctggaccctgtctcaaaaataataacaataaaattcaaaaataatgaataaatgttaaaattaaaaactaaatagctttatggtaaatcttgaaaacagatagcgtgagtcctctctgtcttgttttttccctcaagattattttggtggtgttctatctccttcagagttccatataaatccccctaccccccaaaaaagcctgttagaagttagttcagattgcactgaatcataagagagaaatttaaggaaaattcaccttaacaatattgaaacttcaattcaaaaacacggtatatctttctctgcctttttaatgaatttctgccaggaatgtttccctgtttttcctgcagagacattgcatatctttggtaaaatttaattgtactttatgcttttcgatataatacatgtaatttttaaatcatccttttcaaattatttatataaccaggactttttttctgatcgtacagggaaagtattaactatttcaccactatttcatcatgatgttagctgtaggtttttcatttgccttttattggattgacgaagtttccttctattctcttttttctaagaatttgtgtttgtttgtttttatcgggaatgtgtgttgaattttgtgcagttcatttttgcctctgttgagatgtcatatggttttccgctttatgtggtgaattatattgattggttttaagtgttaaaccaaacttgagttcctgggataagaaccagttataattatgtgttattttgacctattgctggatattttggctaacattttattaagtatttttgcgactatgtttattaagaacattggtctgtaattttgtttctttatataatatttactagggtttagtgttagtgttagtaatactgattatataaaatgtattcgtggagtcctcctgttttttactattttctgaaagaatttatgtaagattttctttcctcttaaaattgatgaaattccacagtgaaatctttgggcttggagttctctttgtgtgaaggttctaagtttttaaaatttaatttaaaaacattataaagtaaaatattcccttttttgatgtacaattctatgcattttaacatgtgtagagttgcataactaccaccacaatcaggatacagaacagttgtatcatcattgtgccaaggattttgatactgaattcaatttcttaacatatagccaactcttcagattttctgtttattcttgctattggtaagttatgctttctatttttcaagaagttttttatttcatccaagttgtgagatttattgacataaagtttttagtaatactttcttcttatctatttagtgtctgtaggatttatagtgatatccccttttccatttttaatgatgttttcatttacttatttttgtgattagttttgctagatgttaattaattttattaagctcttcaaagaatgaactactgtttgctttctgttcttctcattatttccttctttttccctactttggatttaattttccttcctccttcctttctctttttcttttcttttctttttttttttttgagacagagtttcgctctttcacccaggctggagttcagtggcacaatcttggctcactgcaaactctgttccctgggttcaagtgattctcctgcctcagcctcccaagtagctgggattacaggcatgcaccaccgtgcccagctaatttttgtatttttagtagagacagggtttcgccacgttggccaggctggtcttgaactcctgacctcaggtgttccacctgccttggcctcccaaagtgctaggattataggcatgagacaccgtgcctggcttgctttcctttctctatatcactgatttgaacgtcttctttttttttctgttcctaggtacacacacttttaagattgatgtatcttcctaataagtacaccctttaattattatgaaatgaccctttaactctggcaattctccttgtctagaaatctactgatctgaatatggctacaagagctgcaggctgttcagacttcagccgaggtcttgcaatgagcccttatgttttaattgcattgtacaaattttgatatatacttttattgtcacttaactcagtattttgtatttccattttatttcctctgggaattgtctagtagtaaacattttaattcacagacgtggggaatttttaagcttcccttttttccttaattgctaattacatttttatttatttatttctcttcatagttgttgctttaaatatctctgtgccattttgttagatgcatgtatgttgacgattataaaatcatctttattggttgttccttttgccagcctaggatgtccctcaccatcatttataatgcttttaaccttacattccattttgtctgatattcagagtgctatcctggtttttgtttttagttttgcttatattttcttttttaaaaatcttttagttttaatgtcattgtatatgttcattttacacgcatcattcttcccccccaccacatattgtgcatagctctgtacttgtctctgttatttgattagtgactttatacccagttatccttactgtaatcatttttattaagatttttagcttcatttaatgttttctacttggctttactttttgttttgttttgttttgctttcttcctttggatagatcggattttttttcccgaacacattttattttattcttgtagcatttatacctttatttaaacataaacttaggtataaacatagtttcctttatgtctaaaaattatcagtaatttttaagttccccaaatgactcccccactcataaccattggacctcttctctctcagtctgctattttccccagtgttccctctactgagacttaaccaccttctttcctgcaagaattccccatcacatggaaaataactctcagctgcatcaacctctagcctgtgcaacttccccaccttgcttggaaccggaaatgacttctacttttagaaagttcattctctgggcagagtagaagatagaattcattggggtgttattgagacagagagaccatctaggtactcttgaagaagtccaggagactttaggagggtccaggttagagtagtggcagtagagtgggaggactggtggaacaaccgggaggatttggtgttgtatttgaggagtttgagaaaaagagaagttgatggtgccaagtatgagtggcaaatatcagatttcttttattttttcctaccctattctcttccctcccaaattccatttgcatgacttcttaccaaggtttggttctgccattttaaatgaaataagacatgtaaaacacatggtatatgtcctagtatagaaatagtaattaaaaaaaatagatgctagcttccacatttctgtctcaagtgctgactgtatgaatggggaggaggagcctacagattcctgaggaggaacaacttctttttcttggtggcagggtggttagaaatgtaattatttcatttcttcatcttttgaatttgagctgccaatgagacatttaggtgacagaaaattgtatatctaagtctaggattgaaaagagatgatagagattcaatagctgttaggaaaactgtagaagctcgtctagcgggaggtgataaagtgaagagaagagaaatttgaaaagcatttatgggatggattggaagaaggaggatccatcagagaaagttaggaggcctgaattcttgtcccagtctggtttatttagccctgaataaagcacttaaccctctcagggtcctctttctttcttcctttttttttttttttttgagatggagtcttgctctgtcgcccaggctggagcgcaatggtgcaatctcggctccctgcaacttccgcctctgggttcaagcaattctcctgcctcagtctcctgagtagctaggattacaagtgtgcactaccacgcacggaccatttttttgtgtttttagtagagacagggtttcaccttgttggtcaggatggtcttgaactcctgacctcgtgatccacttgcctcggcctcccaaagtgctgggattacaggcataagccactgtgcccggccctctcttcctttaagatctctttctttctctctgcctctcgttctctttctccattcttcattaattcaacaaagatttcttgcatacgtattgggcgccaaattctgctctaggtattgaggctaaagcataagataggatgtggtctttgacctctagtactgggagcaggcaacagattaatcattgctctctgttaagcattatggtagggtatgtttcatacctgagtcaggttgactggaggaaagggtgctgagaaggcctgcagagcacgtccttcagtccaagcttttcagaatgaggagttgttcagacaagcttgggcaaagaaagacaaaagaagtgcaaaatagtattatatggatgggctgaaggagcaataagcagtttggtaggtccatagtgaggcaggcctgacaccgctagaggggctcagggtctcgatcaggaagggcccttgtgagccaagcagagatcttggattttatcttggatgcaatgtagacccattcaaggactgtagggatgtgaaaagtcaggtgtgtgtttcagtgatttcattctgttagtgctatgcatttggcatgataagggaccaggtggtgggcaaggagaccagagaggaagcagttgtagaaatccaggtgacagaggaatgttgaaaattccagaaccacagagcacctgcttcatgctaatcacaggtctgtgtgctgcggcttctgcagggaccaggacagacaggccccttgttctcatggagtttggagtggcaatggaagtgacagaatggaaagaatgagcagattggagagatgttaataagcaaggatttagaggacttgatgagcaattagatattggaagtgaatgagaggggggtagtgtctggtttgaggaagtgaatgggcaaatgacaccactcactgtgattggggaaccaagagaataactgagtgggaccttcagggaaaggtgcccagcctgcacttgtataaataggtctggatctcaggaacggcctccgtgacttactggatcagggaaagaattggactatgtggatgtttacgttacttgattttattctgctccatcattcagtttgggtctgtgactgttgagtcacctcacagaggacgaggtatccttatatctctttccctaaaacctagtgtggggtgagcaaaacagtagggctattgtttgaagtaggtctggaattctgtatcattaatttctttgctcaccctctgatccctgccttcactttagccctcccccaagtcccagcataggctcactacctggattttggcttctgtgtgaactgctgtgggcaatcgtgtcatattcctgtcacagagactctaggatgctccagcgggtagggattttaggatcactgggtccaatctctgcaattacagatgagagaggtgaggcctgaggaggcaagggggcctgcagagcactggtgtagggctacagtgtggtcgcttgattcactggtctgttttgcactgtgccccctccccctcgctgagtgcttagagagcagggcaggaaaagttctgcacattggtgcagacgtttggaaatgactaagcctgtgtgtgtaactttgagacttctcgtgaaggttgtcaagaagcatttgatcacttcagctctgaggtagggagacagtctccttgggcatcacacttgcattccagcagcccccttgtttggggtgctctccaaaggctccccgtaaggaattgtttcaccccgggtgtagaatcacattgcactgcggcttcaaaggaaaagtaaaaaagtgcagaaattaccgaccggagtgtgggaagtacttcttgttggtaagattttcaagtgctggggaagagatgtgttgaaaggacatttactttcatcagcttagagcatctgttttttatactttaaaaagaagcaacacctcaaattatggcagtccctgggcaagtaagcacttgagattttgatctgtacagattcttagagggagcgcctcgcaggagctgttagtagtgatttgtagcacttaactgattctgtagaccgacagtcaatcttggggggaaagggggttcagaggcaatgatagttaaggaactgctccgtaaaacagcaaataagccattgctcttgcacccgagtagaaatggaaactgtacttagcaggctctggagaccaaattagataggaaatgaaaataaattccatgttttttatttttaactcagtgcgcacctccaaaacattcgtacagtgtgggctccatgacgtgttttgcctgctctcttatacagatttaagtttttaaatggtagttagagacactcaacataaaagctgctgctttaaccgttgttgttattgctttgtttttttgagatggaatctcgctcttgttgcctgcactggagtgcagtggtgtgatctcagctcactgcaacctccaccccccaggttcaagcaattctcctggctcaggctcccgggtagctgggattacaggcgtgcgccatcacacccagctagttttgtatttttagtagagacggggtttcactatgttggccagattggtctcgaactcctgacctcaggtgatccacccgcctcggcctcccaaagtgccgggattacagtcgtgagccactgtgcccaacccactttaaccatttttaaatatgcatttcagtggcattaagtacattcaccatagatgtactatttattataggcacagtttcctaaactgagtaaagaaaggaaacatttacccccacagcccagtatagtcattgttaaaattaagatgttagtctccaagtcttttgtttacatgattttgttcaaacctagttgcaatacttttcatagaggttataaagagaaatatagagttataaaggaatttttttaaaattatactttaagttttagggtagatgtgcacaacttgcaggtttgttacatatgtatacatgtgccatgttgttgtactgcacccattaaatcgtcatttacattaggtatatctcctaatgctatccctcccccttccccccaccccacaacaggccctggggtgtggtgttccccttcctgtgcccaagtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccctggtgtgtatgtgccacattttcttaatgcagtttatcattgttggacatttgggttggttccaagtctttgctattgtgaatagtgccgcaataaacatacgtgtgcatgtgtctttatagcagcatgatttatactccttttggtatatacccagtaatgggatggctgggtcaaatggtatttctagttctagatccctgaggaatcgccacactgacttccacaatggttgaactagtttacagtcccacaaacagtgtaaaaatgttcctatgtctccacatcctctccagcacctgttgtttcctgactttttaatgattgccattctaactggtgtgagatggtatgtcattgtggttttgatttgcatttctctgatggccagtgatgatgagcattttttgtcttttggctgcataaatgtcttcttttgagaagtgtctattcatatccttcgcccactttttgatggggttgtttgtttttttcttgtaaatttgtttgagttctttgtagattctggatattagccctttgtccgatgagtagattgcaaaaattttctcccattctgtaggttgcctgttcactccgatggtagtttctttggctgtgcagaagctctttagtttaattagatcccatttgacaattttggcttttgttgccattgcttttggtgttttagacatgaagtcgttgcccatgcctatgtcctgaatggtattgcctaggttttcttctagggtttttatggttttaggtctaacatttaagtctttaatccatcttgaattaatttttgtataaggtgtaaggaaggggttcagtttcggctttctacatatggctagccagttttcccagcaccatttattaaatagggaatcctttccccatttcttgtttttgtcaggtttgtcaaagatcggatagttgtagatgtgtggcattatttctgagggctctgttctgttccattggtctatatctctgttttggtaccagtaccatgctgttttgattactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttgacgatattgcttcttcctttccatgagcatggaatgttcttccatttgtttgtatcctcttttatttcgttgagcagtggtttgtagttctccttgaaggggttcttcacatcccttgtaagttggattcctaggtattttattctctttgaagcagttgtgaataggaggtcactcatgatttggctctctgtttgtctgttagtggtgtataagaatgcttgtgatttttgcacattgattttgtatcctcagactttgctgacgttgcttatcagcttaaggagatttgggctgagacaatggggttttctagatatatgatcatgtcatctgcaaacagggacaatttgacttcctcttttcctaattgaatactctttatttccttctcctgcctgattgccctggccagaacttccaacactatgttgaataggagtggtgagagagggcatccctgtcttgtgtgtaaaggaatttaaagacagcctactccttctccccttctctgccccgtttatagatgaagaagtgaatggccaaaagggttaatggcttgcttagctggacagtggccatgcttgtcccagagcataggtgctccatcgcctgagcgccattccctgggctagtctgttgttagtttcaacatgtgtcataaaaaattcattggtggtttatttttagggtaatcttcttttttcctctgtctctttctttgtgtagtttctgtatctaaacttttttaatggcatcttcaaataggaacttgttttaaaccagaacgtcacaacacgtatgccattcctagggtttatcaccctgatgccaacatcccctcccaaacctcgcttctgttcagatattaccatacccaggaggtcgctgctttttgttttttttttttccatttgttttgctggttcacggttcattccagagtttaaaggtgctaaaaccaaagtttaaaggtgatagtaattgtcccatgttgggtttttagctggtttctttttcttcttaagatctgttttccacttagaaatgaggtgaaaactcacagaagcaaagcctagcagctaaaagcagcacgtctgcttaccacgttacaccctccgggctgatctgcagcccagatcccctttccatcctctacctagctcctcaattcccatcggtgagcagttttcacctcctcctgcccacgtttggaggtctgtgggtggcggttaggaagccaaaggaggctgaagctggggtatattgtttgggtcggccatggcaaccgcggcaggaaaaggaacaggactagttttgtgctgctctgtaaatggccaggattcagcagctatctcaggacttctgcttggccccagacaatctgatctcctggtaaggttattaaacttggctctcctcttccaccctcctttgatcatgttgtcaggcagcgagtaggaatggccgtaaggggtcggctggtgggggttgcagagcacagcaagatatgcaccagcagaaacataagaacaggggcagaggcaaatcagggactgtgttcttatcttttctgcaccccagatgcagagaagtacatccccaagtccttgccaatactattcttcaagagttgagcaccttgctccaaagagcctgtccagatcgccagtttgaccagcatggaggagaacaaggaagggccggtcctggaagaccccaggatttttttaattgggaaagcattatttgagttttctctgctgcaaagcacaaactgcctaccacatgtgtttcataaaaatgtcactgaaaaggagagtgagaatacagagtaagcttccatggcttaataatagtttattttgtgacttggaatagcttttcttttcattcagcggatcattttaggtgtcattcagtttattttaagtagtgtgtttcatcctgagcggattaagaattttattttttaaaactctgtactgtgttgcttcctactgggaaatttacattaaaaaaatgttcgtgagcaaaatctatttggtcaaaaagaatggcccacgattatcactgaatttgggatgtttttcttctaagggacacagttgattcttactcagaatcatgcgagtctgacatttcatttggggaagtctgaggaagttggtgaggtcttacgttaataaaaacaagtgcttctttttcttcttatcacctttcagtgtctgctctgctggctcatgcagtgtaggttggcttacctctccctggaagtcacattgtccttcagaactctttttactatgacccacaaacagttttcagacctcactctgatgagtcaaaggtaaagctgtgaataaacagatggtgaaacaacatttgcagttctctgacttcagtcctccctgaaacccacttggaatctagctctgaattcagccggacatgtttgttcttcccttttcccatcctcacctactcctaaccttcagtgttctctttaccttttatttttatttttgtcattttagtagtaaatgacagggacatagttactcaatttgtaaaacattgaatggtgaggtcaaagattctatgacgagcttgagatttctaacaggttcagatggatgacagcaacattttgctggcttaattttggagctgtttttgtaggttttgaaatgcagtttaatagtgagtaatagagaagtttctttctgccgtggagctactgaacccttgaaagtaacatgctggcacatacagatgaactgtagccccacatttattccttgcttagtggtaagctgtacactgaacaatagaaaacaaaaggctatttttctttggaagagcagatactgatttctggacaaagtttatgttgtacaagttaaacattttttattcttttctggttagattttctgccttttaaaaaattagcttagttgaaaaagcaggtattattaaatacagtttattttattgaattggacggacaatcgtagaattttaaagcttaaatggctttaattgaacctaatgttctaattttacagaggaaacatttgaggcttagtgcggttaaatgaccactcctacaacacacagcctgtttgtttgatggctgaggctgaaaaccagactccagactcctaatttaatgcttttccttcattggtcatgtctttttagcttcagtgaagatcttttttttttttttttttttaatttttgaggttatttaaaaaatactttgccttgaaaatttaacatttccacttaatcattctcatacttcaagaacagtttctctgttaactttctgtttaacttcttaaaccatacactgtggaaattatctgtctatatgctgaacagtctttaatgactgcatgtgtgccgtagctgttgagatgttttaatccactttagcaaaaggtttatttgtttaagaaaagtgcagtgttgtattaagtctaagcttagaacaatgaagcatcatctcccagctactgggagtgagaatgggaggggcagggagtggttggtactatgagctgctctaaagaaaattcatttcagcttcctcacatgttaatacaatcatatttcagtgaagcccttcttcagcaacagtcactaatgatagagtgatgtgtttagacttgaaggttctttaggtgctgtttaaatgaataatgagtgtagttaattcacaatacaggtgaaaagttaaccacagagtagtggcactgctctttctttccccgtcacctctgtgcatgatctcttgctgcgccattagaagggatgattagaatgggcaaatattccctcccggtgctcctggcaataggaaagcactgtgggtgagatatgtctgcagagcagtggtatagtttcaggaagggacctcattctgctctctggggcaaagcttccgggtgcctgagtgggcctcttcctagtcgatggggcagcttgatggggtggctatttattggtgaaaacagtatccatgtcccattggttattgggacttgattcctaatttgaacttaggtgctgtgaagagacttatgtaacgctgtttaatccatgtttggctttgttagaagagtttaaaatactcagaaggaagaaatgtttggttcctttgaaaaggcagactgttcatttagctagggagagcctcaccaaatgagtcaattaaaaacatttggggattaagcccagtgagagtgctgtttttatatgagacatgaagagggtgggggaggggcgggtggaactatggggaaacagcataggaaaaaaaagatctttagaaaaggaaaaagttagccttagctcttcagagagcactgggtgggaaaaaggatttaagtggaaagaagaaaagccctagagatttttgtaccaaaaaaaaaagagtgctgttaaaaagatgaatcaacagctatattctaaatggcgtctccttaactgggatttgaagggaagagaaggcctgagtagagtcttagacaagtccaagggtaaaaaagcaaacagatagttgaagaagtggaaattataagtttggtggcaaaaacttacttgtaattagaatttttgtgtccttaatacttgttgttatgctgatatgataatatgctaataatatgctaaggaattttcccaattcataatctaaagcaaaattaactaatatatgttctgttatggaaattcacctaaattgcaccagcaggtgtattcatcccgctaatactaacactctgttactagctccactgtggcgtttccactgtaacgtggtggtgttggtgctactcattgtgacagtgtggtgtcccaaagagtgagcaagcctcgccaacgcttccttaaaactcttactgatggaactaccatgtttatatagcaagaatattagagaaagaagagtcgagaaaggattccacaacacacatctagtcttttcctctcttagcttttagggtcaacactacctttctcttggaaatgagaaggggagaaaaccttttccactattctgaaaagagggttttaaaaattctctcaggtcgcctaagctggaggggctttatgacagcactaaccagtaggtcaaaaaggaaatttattttttcccatcataggttcctctctacacagagaatgcaaaaccgtaattcttaagagttcctcaatgattattcacttttgttcttacttccatatttctctagtaaagatttaaatatttaattttgtagactcctgaaataactgcttccagatagtatatttactcagaatattatttaaatgcattaatgctgacattgttagaaaggggagaaaactcaacattttccggcagaaatcattgtaaaatgtattataaaatttcctcccttcctaagtagagtgctactatatagtgaatataatttaactttttttcttggagacttattgtcatttctgtgaagttattacctcgacatagtagcgtcctgatgcctcaaaagctcataattcttctcgatgccacagcctctgtcctatctacttgtcttggttgtcatgtcttcaatctcctttcatatttgcctatatctgtaaacttaagagaaaccagataatcaatctgataaaatcactaagctgaatcatatacattaattctcattcctagctctctccacctagccagtgtggcctgaggcattcatagccatgttctgagtggtgaaggctaagagagcccaggagagctgtccagggttaaataagacattaatatataaagtaaggactgtcggtatacgtgatatttatatgttatcatattacattttatttatttatttattcatttatttatttgtatatatagagagagaaacagagtctcactctgttgcccaggccagagggtagtggtgccatcatagctcactgtagtgtcgaactcctgggctccagtgatcctcccgcctcagcctgctgagtagctaggactacagacttgtgcgaccacacttattttttgtttttaatttattttttgtaaagacagggtctcattccattgcccaggctgcatttttaagtttagtaactgcccaaatggacattgggtaaaataaaaataaatacagtcacttctcttcttaaatcattcacctctcaagatgaaggtactaataggacattttctagaacttcagtgttaaccacagcaaggaggaaagacaggcctgttagatgtagactaagaacttcagaagctgtctccgtcctaggctgggcccagggctctagaattgtcccacacacctggtgggcttgcttgggtacttgggtggtacctgggagatgatgacctgttcatcttcagcttctgttattccaggaaacagaggtagtcatctggatactacaggtttgccagctctgctacttctgcttctactgcaggaggaggagctatggaatttttatgcatgcatcaaaacactgacttggctcataagactgcttaaaagacagagtgataaattacgccttgtttctcatgaaacagatttttcccaaaagtagaaatactaatttataatgtatccttttcagaaagattgtaagtctaagtttctcagagaaacagtgtatgtgatggcaggaccccagtaaagtccaaaatatcccataatggccttaggaccatgcccatcatagtctccatagagccatggtccccaagagccatggtgcccaagagccaccacttcagtgggtggtaggtggttgtgaagaatggtcactgtggttcacagaataacagtgacaattgtgaatagaagccagtcattacctaactgataaaatgagtgaggctagcaaagggcctgacaggaagtgaaatcacttactgaagtggtggtagagtacgcaaccaagaactaagaacaggagggaagttaaccctagggagagttcgactccacttgaggaggaacattctggcaatcaggactgtctaaaaatggaacaagctgattgatttagcagtgaaacctctgtcactggagatgttcaaacagaggtagtaggaccctcttatcaggaattctccagagaggagatgtgagttggatagaaggttattgtagacgaccacttgtttctctctcagctctgaaatgtagtccttaaggctgacgtgtgtttcccagtttctaatcggaaaagataacataatctacagtgttgaaataatttaaacaaagtaaataactgtgcttttacaaccataatacggtttagcctttcattattttgttacgttcctcattaacatagacataatttcttttaaagaagggacaattgtgacgagcctgggcaacatggtgaaaccccacctccactaaaatacaaaaaattagctgggcgtggtggcacacacctgtaatcccagctacttgggaggctgaggcaggagagttgctagaaccaggaggcggcggagcttgcagtgagccaagatcacaccactgcactccagcctggcgacagagcgagactccgtctcttaaaaaaaaaaaaaaaagaaaaaaaaaaaagaagtgacaaaacttacccagtaaactaaatgttaatttcctcttctcaggagcataatactaacttactcctctgtttttatatttttgagtactgataatcggatagtgatatatttgtgttattttttgttcaaacaattgaattcattcttagcaagaacaaaagtctatttgaaacatgtaggcatcttaggtagattaaatttttcattgtttcaagttttgacttttgtatttctgcacattagtgatccttgaagattaggcaaggccaagttcttttgacttttataattagtgtgtcggaatcccagtttttcctaccctagggtggactgtattttttacaattaactctgtgaagggtgactgggggtggactggtgaggagaggcttccagttaccagagagcctgtgacttactctctgtgcttttcctaggtcaccaattttcaaagaatttgagtataattaaatacacttcataataaactaggctgaacataatttaatctttccctgaaggtacttcagagtcttggagtgctttagggccatgatgagcatcaattatgttctcacggtgggtgtgcagaaggaggtagttaatagagttctgtttgatcaagtcctgggtgactggacatgtgttctgttatgattagcagttcagtgtccaggttttggaactgatgcttagtattaaattctcaggcaggagagaatggaatagagattgacctctttggctttgagaggctgaaagttgatgacgataattcacatgtacatggtatatatagcactttttagcttccaaagccctttcacataccttgtcttccattgcttgtttcttgtgatgttctggaaaggaagcaaggccgctggtatcccatttttacagatgaggacagtggagctcaggaagcttgagggacttgcctaagctcatacagtagatcaatggcggagaccactggacttcaaattcagtgctctttttagtatttcaaaggatactaaacatttgctcacatctctgatgttctttgtgctgtatgtgtagtaactcatttaatcctcacagtggccctgttagtaggtagatatcagttcttctggtactattacgattctcatcttcagagctgaggccactgagaggcacagagaagttagggcatgcactagtgagtggcggagctgaaatctgaacttagagctttggctccagagcccatgcactccaccattatgctacatggctactcagtgtacagatacactgagcttaagtagaggagaaagcttatctatccatatcttcccatctgcaaagacctctgcctgtatgggaggtctgggctcgttctgactaaggttttgaacccagatctgccaatttgagatcttgggcccattacttagcctgagcttcagtttccacatctctaaagtgaaaatatagaacatggaatgtacctgtaagaacacaatggaatacaggtaaagtgcccagcacactgcttattccttagccttcatgttttagaaagtggttgctattgtttttgttgttggtggtggcggtagtggtcttcttcttattattatttatatatttacaatggccaaaattatatgaaatgttttccaaaaattaggtatttgtacccttcatatgaatgtgtgtgttaattgggtataattgtctttcttgagtctttaaaatagacaaatcttttgattacatttgttaatattattgtacctacctatatctgacttgacttacaattttacttcattaaatacatagcaagtcatctgagaacccaaagtaatcatacagattacttgccatatagttaatttgtgactgtgatatggctgctaaggtagaggtttgaatttaaaagcacaaagaaaaatgtttacttcaatggttacaaatagattaatcatataaagtacatatttgcagagtctcgctcagtcgcccaggctggagtgcagtggcatgatctcggctcactgcaacctccgcctcccaggttcaagcaattctactgtctcagcctcctgagtagctgggactacaggtgcgtgccaccacgcccggtgtatttttagtagagatgaggtttcaccatattggccaggctggtctcgaactcctgatgtcaggtgatctgcccgcctcggcctcccaaagtgctgggattacaggcttgagccaccacacccggcctattctaaggcttgttctaaggctcacagatggcaccttctctgtgtatcctcacatggtggaagaggcaaagcagttcctgggggagttctttgataaaggtgctaattccattcaagagggcacctcccaagggctccactccctaatactatcacgtggggagttaggattcgacatgtgaattttggaggcacacagacattcaggccaaggcataaacagtgaccacttttgttctgtctgtccacacactgcctagagcttccatttatttcaactacatttgcttttttcttatttatctgttcagagtatcttctcagtggctatttatttaccaccctttaacatgttttcttgacattgtacttcagcctgtatatgctttgcaactcaggaactatgctggcttaactaatagtacctacttaacaggtgaaactgacagtaacagcttaataggtgctttccatttttaacatacctcagctttttataaatacaaaaaactctcaatcttttaatgtggttttaaattttaaacaggtcttctttcattttcctttacagaaaactgtaatactgcatatgcattttcaaactatgcatatttcttcttcattccatgtggaagtttttattcagcctttcagtaaattttacttagcttgtcccatggatgccgtaggtgtaaggaatatgatagtgaacaagacagacagagctcctcccctcagggagctttgccatgatacacgatgatgacaatgataaaaggagcaaataatgatttgggacctgattccaaagggatatttctgcgacacttacaatgaaattccaacctggcaccatctttttcactgcagaatgcatgaaggtggttgcatcatgtcatttcgacatgcatttaaatgtaatgaaaggcacaagtagtgattgcaaacactacaataagttgcttgttgactctcttactgtcttccttcttatctccctttcttcctttgtctcattctcagttttcagagcttagtcattatttcgtaatcctctcctaaaatgaaatctggggctctaaggacaggaggcacaggttgtgtttgaacagcatcatcgtgctttatgaaggggattggaggggagattctgccccacagtatggtcaggtctcgctccaggcagcactgactacattggtgctggttgggtaactgtggctcggcaggtcactctccctctttccacctccgttttctcattattagtagaagtcgaaatagcatggttttctaaggcctctgccaatctacaattctgtgattcatatgttcctaaacacttgagttactttttctcaataaatggaaatatattttccaatgaggctggaaatacattttccaattatcctctcccctggtttataacatatcatcaatgtgttgggacttctaacactgcttctgctgtaagcccatcaagaggttaattacctttgaagaatgaggaactgctggaaaagaactgtaaaaccttcaagagaactttggagttaatccctctggtaataggaatcaatgtcactcacacatctagttgccagtggaggaggaataacagcactgggccaagtagacttgaaggaaggcaggttgctgatagagtggagagctgaagattctgaatcaagctcatcatgactctcttcctcctctttgaggctacccaatcagagcaaaaacagtattttaaaaaacctcaactggatgagcctgatgcagtggtgtgctcatgcagtcccagccaaagggtcacttgagcagaggagttcaaggccaacttgggcaacatagtgagaccccgtctctaagacaaataataaacatcaaaattaaaattaaaaaaaacccaacccagtgttcccttcagaatcctgagtggtttgtttcatcttcctctattctggcttgtgtcatcttcctctcttgtaatggataaaaactccaaatgaagacaaaaatgaggaatttgtcaaaaaaattgaattgccaacaaaagccatctttggttgatcaaacggtacagacgtttcagttagacaagagggctaagtttctgagacccattgtacaggattattaatattattcatttttagccctcataataaggtattataaatgtcaagattgctaaaagaatacgtttttaaatgtcttcattataaaaaataagtatgtgaggtgatggacatattaatcagcttaatataatcattttatagtatatgtagctatatcaaaacatcacattataacccataactacatgcaattattatttgtcaattaaaaatacaaatctaggccaaggtgggaggatcccttgagcccaggagtttgacagcagcttgggcaacatagggagactccatctctacaaaaaaaaaaaaaagaaaaaaaaaagaaaaaaaaaggaaggaaaaaaaagaaaaaattgactgggtgtggtggctcttgcctgtagtctcagctgctcgggagctgaggtgggaggatcccatgggcccaggagtttgtggctgtagtgagctatgatcatgccactgcgctctagcctgagcaagagagtgataccctgtctcaaaagtaaaaacttacaacaatataaaaaataaaaatttaaattataaaaagccatcttctttcccactccttcccattttgatacaacagtcccagaccccagacttgctttcctcatgagtcatgcagactcaagtattgcagttccaaaacactgcctgactcaccagctccatccaaaagagtatgtattgtcttcatatgccagataggaaattcctgctgcatataggaaaagcagtgtgtttaaatacatggacacacacacacatacacacacacagagtacacatatacacatctgcatatacacgtacacatatgcgcacatattcatactatatatgtacatacacatgcaatacacatgtatacacaccacacacacacatacacacacatgcatctccaagtctatttccatgctttttttcagtaaagcacctagacaaaggagagagatgtctaatcaggttttggtggttgtcagggatatcataaatgagaatctcaagttactaaacttgatttcacaaaatagtttattggtagttttagaatggcattgcattttaggcagccccaattgtaaataagtgagccgggtaaaagcagattggatgtcacccagaatattttctggaaaggggacatacacaaaattctctctttgcacaattaccctgttttgggtttgcaatattatgttgagcaaggctggctattttccaccaacaggatgttacagcttgtcaaaagttattcaacctatagtgttaagcaggtacttcatcattactgaatttggttgatgctctatggagaaagccaaagttaggagttttgtctgtcattgaggtagagaccctcaactagggaagctttgaactgttcatccagctggtattctgtaccaccttgcctctggagttgagcttagaaccctacttccattttttctgtcacttcagggctgtttcaactattgtttcttcatttacttatatcaagtgtgttttctcaattcataagcatgggagaccccaagagacagatatcgcattagtccttttttgtttgtttagcaggaaggtttttaagtaaagctcctaaatgatatgtctcattctcatggaaattcatcaatattgttttactgtctcctatctggttactttttattttaggtaaccactgtgatacaatatacacaagtccctggatcatgaaaataaattgaagagctaatgttaatagtaagttctcaaccaggggttatgctggaacccaggatacataacccacaggagggccctccgtgaactcagttttcatggaattgtcccataccttcacaggtagaagcatggctatgttaaaagtggccaatgaaagtatagtttctttatgccttatactttgtttggtgaggatttctgccagaggtgtttgtttcctttagttttctggttgctatgattttatacagctttggtgacctctatgagtaccagataaagttaggtatgataaaggcacaaaaagaccgtagaagccatttgtattctaaatataaatatacagactaaatttgtatgcatttgtgtcttcattcttcacggtgctgtatcctccgtgtgtgtgtgtgtgtgtgtgtgtgtgtgtgtgtgtgtatttcttctttgattccaggctgcttatacgaaaatgctgattcatagtgtcactgtcttttctttttcctgcgaaattctaaatccgtttctaaactttttctacaactctgagtttaatctctctaaagtttttttttttccctcttgcggacacaaggcactttgctttgtttatgctaataaatgtcagactagcccccaaaaattagaagaaatgccagtaatttcaaagggctcttgagcatgattttttttcctgtttcttaatacattgtacttttcagagtttaagtttaggtgcatgtaggtggtattagaagattcttagattttattggtagcatccagacaatcttgtcatcacccgatatatatcacctctatgtggtagacccttgtggaaattttctcatcacgaaagtcgaaagtttaattttggagaggaagaggtttttcagatacattaaataggttttgctacaataaggtgagatggtactttcaattgagcatttctcatatactagcaagcagacagcttggcctcctggttgtaattacatgccaatggcttggtgctttttattttagaagttgagttcatcctgaattctctgagcatatggagtagtgcactctgattgttcccattaagattgtaattccatccaaggcttatagtgtcattgtaaacactagatggaattacagccccatgcacattttggaagactgcattattcattgaaatactttataaagttaaataattttgtaaatatgctccaagttcatgggacttagatagaaacataatcctggccacaaaggaggttctcagtaaatatttcttgtttatttgatggactttccttatatctttaaataaactgtatttttaaaaagtgtagagaggttatacttaaatatttgtaggactttaaaagatcttgccttgaaatgctcttacggtttcttgcttttcattgatggaaaaattgacttcccatatgaatatgttatttaatcttttctgtttctagcctagagagaaatactgagtagctcgagtggtcaagaatctttattttagggacatccgcatgtcctaagtaattcccttctatataaatatctcttttcggcataatgtgttgcatgccttcaaggtggaccactatgaggtgaataattacacaacgggaagcctggctgtctcgtggaatattggatggatggctttcttattggtcttaattaggacagtgttgttaagataattcactaattcacagtgcgttatcagatttgaaatgacctcttttttttatactacttcggaagtgtatgtataccttttaggaaagacctggaaggataagttgtatattttagtatctgatatggttttaaaatttaagactctgtgttatgtatgttttgggatgactataaataatctgtgtaacaaggtattaccaaaaaccttattgcctttgccaccatgcactgcaaaatatagtatcaggaagcgaaaagacaatgcattttgagtaatttttagaatttgcatttttgtgaattgacatgtatgtatggaggacttttcaaaaaaaacagaacttttcattaagaatattcggtattaagatattgttttaaatgtcagatatttttaaaatatatgaaaccatattaatcacgtattacttatactttttgtccctggaaatattccatttttaagaacagagataacaaataaatataccagtaaagctaaagtcagtgctttctgctcttaaaataatttattgaacgataaaatgaatgtctttgctttgtgaaattatatttttgtttaggacttgataatgcttagagaacattttagtttttacagtttaaagaatgaataatgactggttcctctgctccctgatttgtttccatgtagatagtacttcatttttattacctgtaaacatgtgttagctttatcaattaggctcaattgaatgaagcataaccccctgaaaggccttgccagtaaaataataatagtaataataatattcttttcttcagattctagcagggagtactgctggcttttatgtaagaagtcaactttaaaagtgtttttgtgtgcgtgtggtgtgggtgcagcagcaatattgtgtattcctttcaaatcaagatgcctcatagtctgtgggcgggggaactccctaagatgccctcactagttactcattcatttgttcctccccagaaagggaaaacccaatgctccacactccacttattctgaataatgggggcggggaggtggtggcgtgaggatgtcagtgtcattgggcaaaagccttcatttttaaagtttagcaaaatgcagttttattgctttatgatcagtgtgtattacaagctaatatacaaatggcattagtgatcaaagtgggatactgatgtggcaaaaatttacaatacacttaacagattgacctgacataacagtgaaagcatttgaattccttcccacatagtaagtaacaagtaatttctggagccagaagtgggagggtgtgtgtgtatgtgtgtgtgcatgtacgtatgtgtgtgtgtgtgtgttgtctgtagaagttaacaaatatgttagttcattgaccatttctttcgttgtcctaaagaaaatttcactcacttgtgcttctgatttgtttcccgtgaagtctcttatcactcttagaacatgaaggcgaattaatgaagaatccttaattcttcaaaaaaaaaaaaccagccctaatttaagaaaggagacatttaacttgctaataagatcctaaaattttataggttatataatacattcaaggaaattgaattatatattcattaagaatacattatctctattagcagagagtaaatgattgaggttttactgaacgctaaatgctcagaaagtaaatgcaaagaccatcactggttgagcacgctgggaactgggtggaagtcttaggcctgtcattaactgttgtgcggcctttggcaaataaccgaagttctctgagccttaggaaaatgaggaagttgggttatataagtggttttcaaatgtggcttcagaaaaccctggagagccactgcactccagcctgggcgacagagtgagacaggcctctgtggaattagccaagggtttgggtaaggggtggggctgagacctgagaatctttatgttacaacagctattaggcaatgtcagttcacaggaccactaaatcaaacaatccttcagaccacttccgactctcaagtttcaataagtccctagaaaacatcatccttggtccacaggaagcaatccaataaggaacttggtctcccataaagaatccaataaagaaaactttaaaatgagaggagggttatggatttgatcatctccaaggacccctgtcaagcaagtctaagatctttccaaaggagatctgagaaatatgtctgtatcccaagaaggtttgacaatagtccctgaagtttgggggatgacttctagatatccctgtgccttcaagcgtgatcatgggctggatttgttggccccatggtctgcctctgagtcacagacaaatgatgaaaaaaagaacaattttctgtcagcatgccagaccaagggaggggccaggagaagaaccgtgaaccatgaactgtgccactgctggaggcactgacagctccttggcaccagatgtgtgacctcaacccctgcagcttgggcacagataatatctcagggcaggggatgaggaatagaggaagaagggaaagttgcagggatcctggagtgttaatacccatggtggcggcagagcaatttgccaggaagaaaactctctggttaaccctccggcactagttgccaagcatgtttgtactagaatggagttcaaagttacaaacagagcactgtctgtttttaaggactcatatgaaaggtttgcttgtcctaagcctgaatccaagagtctgtctgtcataaacactttcaggtagcccaaaaatcccttcaatgtgatctccagaataggggaagacaaaggactcaggtcttcagctgtctgatgaggagtgagaaatttttctaatgaacatctctggcttatggatattaaggagagttcagtgtcaaaagtttctgcagcgtagttaacagaggtggaaagttgaaataaccttaaaggcactgaagctgagaaactgccctctttatcctaacagccacagttagttttggaacactgtccatggagaagctcagggctgtcaatttagaaagcagctgtgtgctggcccattgggcaccatctttctctcataggttgttctagtccaaggtgaagaaagctacattttgctctaagctagactgacatatggacttctagatttgaaccctaaacacaggaggaagtgattgattgtattacaaaaagaatcttctttggtaaataactatttttttttttaatggccagatgggagaaagcaaaagatgccttttcgtggtgttttggaaacctagatctcatcaactccctggttggttttggcggtcaaggctttttatgccagagcaactgtgagccaggtttctgaggttcttcctgacccatgttggtagcctcttaaaaataactgtcattccaagttcagctaaaatatataactcaacaaataaatacatataaagcatatgaatagaagcgggaaagtgaggattaacagactggagagtaagagtcttgccatgtaaaatactataaaacactcttaggaagtctcttgcttatgttattacttgtacagtaaatgtggagacctggatctcttcctcatggtcccttatttcttgttttcctgctgggaggtttcaagtagctgatcccttgcacatgtactttaaaacttcaattatatttgtcactggcttatcatgggcaatgtatgtgaatgtgactaagggtcctgataaattaaatgccacttttacatgttcctttctttttcttctattagtgttctttaggactttgaatgggaaatcctcaaacatgtaagtctatgtggcttcagaaaaccccagagaggccaggcgcggtggctcacacctgtaatcccagcactttgggaggccgaggcggacagatcacctgaggtcaggagttcgagacaagcctggccatcatggtgaaactgcatctttactaaaaatacaaaaattagctgggtgtggtggtgcacacctgtaatcccagctacttgggaggctgaggcacgagaatcacttgaacctgggaggtggaggttgcagtgagctgagattgcatcactgcactccagcctgggtgacagagtgagactccatctcaaaaaaaaaaagttctccccagtggcctctactgaattatccaagtgcttgggtagggggtgatgctgaggcctgggaatctttaataagaaagaagaagggaaattccttatgttggacccaacattgagtgtgttcagatacagatgttggcaggtatgggggcattcggaaggagaacagcggctaaccaagctaactgagactgagttcaagattcgcttctggttcagggggactttcgttttcaggctctaatacattcagaagagcaaatattggtactttaatcatgcatcttttccccctcaagttctgtatctgccacgtgtatattttatttggcatttaaatgcacagttcttataattgctgataaatagtctccattgcacattttgctggcactgtggcctcactgtaaatgctctctgtatgttcttgggaagttgcataatggcagttactctagtttactgtgcaatatgctcagtgactaatggcctaatcatgacttgaaaaatatataaacagttcaacagaagcagttgattcactgagctctttcatccagacaagggtgagctaatgggaataaaaaagacggaggtgtgcagcagcgtctttgatgtattgaagttagagcattcccacaaatcccatgcattattgctcattgatggcggatcctttttcatatgcatgaggcaggagtgccaaattatcgtcctaattggctctgacttggtattccttaatgttcgtgttacacttgttacaacttttttcctttcctctaaatactactgacagtaacagctttggagaggcaggctgtcacgtggccccatggcgtcaccctacactgcaggcttaagtgtggctctggtcctgtgctctggtttcttgggatagaattacagctgagactgtgcagtgcggacctgcctggtttacttcaggggcattgttgattgacacagattcttgttcccttgtcctcagtggcaccttttcttccaagaggaacagagatagagtcttacaacagccattaaatagaagatcctggggtctactggagcactgtcccattggtggggagaaataacaatcatcatcatcatgtctcccttcctttggaattgattaggtagctcctatattccacattcctctcacctgttgaccacacacaatttttggtcttgtagcttggccactcattttagctcaatcactggtttaatttttttaatgaaatcactcaatcgatagaggctaacctctcgtagatgtaataattccaaccattctcaaagaaataatgaagggtggaatattatgctttctaaaataatggaatttattttttctttatgcccacagctgtttagtcctaaagagggggaagaaagaatctttcgatcttttggcatgttccatgtcccgtattgatggtcatacttcagcttttttctggttgtttaagaattatgtggccaataggctgccttgtatataacagtgaaaaacacccattacttgtatttgtttcattttaaggtttaggcagttggagcataggacagtaactggtttcccttgttttctggaacctgccccttgctctctcttgggtgatgcctcacccctgccccagtgtcagagctgccctgggtccttcttcccttgaagggtctgatgaatgaaccacacagcttgttagtatctcagtttgttaatcctcccggaggaatgtatgtttcaaaaaagaagctgaaaagtataatggatgagaatttgctttggaactcagcacactgtagattagagaaggaaaagaaagaaaaggaaggaacagaaggacatgtttggggggtagggggcctttctggggcttctgaaagcaaatgttgtgataattagttacagtgtcccaaagatgcctgggtctacccctgaccctctacacaggccaattctgctcccaccagaaaaaaacaagagtacagagcaaagaggcagggcagcagcctctgatacctatttgaactttacacattctgatagaatttattatctgtattgaatatgggagactgtgggtaaaagacttcaagacagtgaaaaactaggaaagaaaaataaaggtgtattgggccttggcaaatttttgacacttacttgactatgtgctttaactttttgaaaaggcagataatatagcaatcacattaaatatttatctttaaaagaaattattttaaaaattactcttaatattaccacattatgaactcaataggagatcctacagttcctttaactttaacaacagtacatttgttaatattcattaaagttaaagaagcttactattacaacagaatgaagtaatacttgctggaaaacaccaatattttacttatctttatctaatccccccgtttaactgtagtgatacaatacttaattttaaaagaggaatggtttgaatgtacagacttttacatgtgttcttccattgagttctttcttgtagtctaacccaatagttatcacacttcagtgtacatgaaaagtgcagtaaaggattgtgcagtatacataaaatcctgtgtggagtgtcttgtgggaaagccaaaggattttcaaagttaattttgactatatatgacttttgcttaacttttgaacttaaccgcccacataaaaactcactccactatatttcccttctctttgcctccctacttctgtcccccctttctcccttttttccttcctcccttgtattcttccatccatccatccatccatccatccatccatccatccacccacccacctatccatctatctatcctcccatccacctatccacccacccatatatccatccatccatccatccatccatccatccatccatccacccactaactcatccatccatccatccacccacccatccatccatctattcatccttccacccatccgtccacccacccacccatccattcatctatccttccatccatctattcatccatccacccatccattcatccatctatctatttgtccatccatccaccctcccacctatccatccatctattcatccatccatccatcttttcttccatcactcctttctttttttttttttgagatggagtttcactcttgttgcccaggctggggtgcagtggcgtgatctcggcttaccgcaacctctgtctctcgagttcaagcgattctactgcctcagcctcccaagtagctgggattataggcatgctccaccacagccagctaattttgtatgtttttgtagagatggggtttcaccatgttggtcaggctggtctcgaactcctgacctcaggtgatccacccgcctcggcctcccaaagtgctgggattacaggcgtgagccaccgcacccagccccttcactcctttctttttctctttccctgccttccttttgataaattaacttaaacattttttttggtgaaattaatatggtgatgtctacttatatttaaatcagaaaattattagtatgctgaatattccaatctcttaggaatgataaaaatattctataaaggtcaatcttaattccacatcctatgttcctactcagctttctgtctctgatttctcatttttagctgggaacatcccagccaaaagacagccaggttctctgtgagcatagcatatcaaactaactgtaagaaaataacattttggcttaaaagccatcttctaatataagatagaataaaaatgataatgattggtatactatgtggcattgttagtaagaatttgaagtaagatttacctaaatcgctgaaaatattgaatagttggctgagactttagaattggtacaaacatgtacattttctcaaaatcaaaagaattaaaatagatatccaagaagtcagattatgaaaaaataagatagtcaacggaaatcctaaaagtaacttaaacattggcattggacatatttcatttgtatttctgccatagaagagttaagttaatgtgcatttttgccatgcaatggcaaaatgaagagacttttttttcccttctttttgctcttggtaaaattaagtggcaaagaaaagatagctctgaggttattgctagaattttgtgctaaaaacattttggctagagcagcaagtttttaggcaaacagcccctgataaaagttgcaagaaaaaaatctcattcgagtgcaccaaacacttttcagatgaccatttaatttttttaagttgcataaacaatttcaagtgcactgtaaatatagaaaatagggtatgatagttgacagaaacagaatgaattaagagcagtaatagaaaattgtaaacaattatatctgaatttcatcagttgtcttgcttacattcacaattagtcatcccgtgaaagacataggtgaacatttagctgcttaaaaaggaattagctgcttgaaaggacaaatgttcatgttaaatttcatgaagactaaccttcagcagacaacggcacaaatgtgtcagctttttctggtgtgaatgaagcaagatacaggcaaaacagatgagataaataggacttggaaaaaaaattctactatacaagttttgtatccccatctttttgctctttgtggagcacctactggaaaccactcctgacctaatgatgaggacacagagagaaaattcaataagcaatggcctgaaaaataatttttatctaagtattagataaacgcagtagcatatttgacttgtaaaaataacatggctaggctttgtatgcctccctgtcctcttacctacgtgggattttcaaatagcactgattctggggaggggaatcaaaaaatagaagactcccctctcccagagcacacgtaattaatgcctgtgttgcagctgggagctctctgccagcagagttctttgctcgtcatctctcagcgctcacccacattccccttgattcacaccgtattgtttgtttacatgtttgtctccctgactcaggttggaaatctttaaggacaaggacaacctcttgttcctttttacatttcccatggtgctttgctcgcagtggccactacagacatgattcattcattgttttaaaaaaagtgttaactagttaagtgaaaataaaatgaaacagcaaaatgagacaaacgcctagatctgaaaggctacaaaatacagcagagggttcagtggacataagaggaaaggaacacaatgatatccccaatcttgtgatggaatagaaaaaaaaaaagtgattggtgttgatgtaacacttttcttggccagttgaacattccagagtagaggtcagttttgtagttaaatctggtaggaagatgtttccaaccagaaggaatcatactaaaattattttatcacaacaagcagtccataaccgaaactttaatttgtgagttgggaatcaggataggaaacccaattttatattctttttataggaagaagaatccattccaccactcagactgctttcctctttcataatcgtggcatactctgccattgtttgtttattttccccacaactagatggagagtgcaaggaccatattttactcatgtgtatcctcagggcctagcacaaagtaggcactcagtaatgaagaagtaagatgtttcaatgtccctaacatttaaaaggatgtatgaaactagtgctaataccagaaagagttggttttcataggctgttaattgtgggttttgaaataatgtactactttgtacattgattttatacaactgtgttatatacttcagtaactttcaaggtaaaaagttagaggttattaaatctggcagggtcttaaaacctgagtctcagtccatgtaagagcattcttttgctcttcttgactagccatgtaaaagggtgaatgtaagttagtgaattatcttttagaaatcttcagttgtatatatatttttttcatcgaattgcaaactcactcacacttaccaatgtaatactaccctgttgatgagcattagtagccttatttgggtagccagattagagacacaggcttcatggtgttacctgccttgatgttttcattcataatgcagcatttgggaatgcagcatttttctatattggagacatgtatgatgatgtgtatgttccttccccataaccctgtccgcttctcctttggcagtgtcttgcatcacaattttattttatttttatttatttatttattttttgagaaagagtctcactccgtcacccaggctggagtgcagtggtgcaatcttggctcactgcagcctccacctcccaggttcaagtgattctcctgcctcagcctcccgagtcgctgggactacaggtatgcaccacaatgcctggctaattttttttatatattttttttagtagagatggggcttcaccatgtcagtcagactggtcttgaactcctgacctcaaatgatccgccagcctcagcctcccaaagtgctgggattacaggcgtgagccaccgcacctggcctccaattttaaatatatgtaggctccatctccacctctccctgaaaaaactttccctgctcctttcgccttcatgtgtgccataagttgactgccatcaggccaatatcattacatataaattccctccacccttcgttttaattttaaaatatctgaaagggggaaagggagaagattccctaatgagtatgttgtgtgattcaggaccttggctcttagatcctcagtcatgtgatattttcagattttatgggactatggtgcaattgaagaaaggcttttgacagaaaatgtgaaatgatgaagtcttagcacggactcatacggcagtatttgattgcgggttaatctccaaacgttgaaataaagtggatctgttaaaaagccattggttactttcagttgccaggggtgtgtatgctcacattcctggaagcacattctataaagtcaccaatctacaacacagacacccacctccccctagacttcagagagctctgctgggctgcagctttctaccaaaagagttgtgtgcctctgaatttcacatccaaccttggaagctgcagtctgtttaagatttcagaaagaatgggggctatgtttccagtttactgctttgttattttgaaattgaaagtctgagcagaattcagaactacacaaaacaggatcttttcacatgtttgtttaagtcatgttcttggcaaaaacttgctgaggaaatgatctgtttctctaggagcattgatttcttactccagtacagtggccatttcccaggatctcattccaaaccatctgttttgccatcagagccagcctttcagtgaatgatctctttggtctacactgtgctaaaccttctgattgaaaggatttttattaatgaaatctaggtaataaagttgcagtgaactttaggaagttctctgtaggcagggcgtggtggctcaagcctataatcccagcattttcggaggccaaggtgggcagatcatgaggtgaggagtttgagaccagcctagctaatacagtgaaaccccgtctctactaaaaatacaaaaaaaaaaaaaattagctgggcgtggtggtgggcgcctgtaatcccagctacttgggaggctgaggcaggagaatcgcttgaacccatgaggcggagcttgcagtgttgcagtgagccgagatcacaccactgcactccagcctggcaacagagcgagactccgtctcaaaaaaaaaaaaaaaaaaaaaaaagaaagttctctgtaacagtcaaatagcaagtgctgacctctgtcgcctctgtagcagcagtatggatgaattgtgagcttgttggctaggttgggctgcgggtcattgtggaaaagccatgtttcccttgcctgtggctgggaataagtatagtggggccattttaaaaaaaagtcctgtggttgaattctgagtttgagctgttttaaaatgtcaaacagactgaatccttgggagactcatttgaatgagaccagcagcaatgtaagaatatatatatatataaaacacgttagagcatttccatgtatgggagggaactgatggagagaacacagaccaccacattaactgccacatgctgtcaaccagtggatctcaactggggaccattttgccctctcaggacatttggcaatgtttggagacactttttgatcgtcccaaatgggaaaacaaggtagcaatactggcatctagtgagtagaggccagaaatgctgctgaacatcctgcaatggggctgggggcattggctcacacctgtaatcccagcactttaggaggtcgaggcaggaggatcgcctgagctcaggagtttgaggctgcagtgagctgtgatggcgtcactacactccagcctgggcagcagagtcaggggtctcttgaatgaatgaatgaatgaatgatttttaaaaatcaatcaatcaatcaatatcatatcctacaatgcaccaaacagtcctctgcctcaaccaaggatcatctggcccaaaatgttaatagtgctggagttgagaaaccctgccttagaccctttccttctcatagtttccaagctgataaatcagcctgccttgacaaaggtgaggaggtaagctgcaggcgtgagtgggaagagcaggataaggaaggaaacggagaaaagaggtagcagcattgcatgaaaataaactacccgggccatatcccatttgtgccaaattaatatttgggattctgtctttatgtgtttggtaaagccggaaagtatgtgggtggctggctgggccatggcctttgtgttagaggtgacctgagtttcttcaaagcacctgtgttagtttttcattgctgctgtaacaacttatcaggaactttgtggcttaaagcaactgtttttatctgacagttctgcaggtcagaaatccaatacaggtctcaccaggctgaaatcaaagtgtcagccaggctcattctctgtagggactctagagaataattcatatccttgccttttccgttttctttcttttcttttcttttttttttttttttggcgggggggaacggagtctcattctgtcgcccaggctggagtgcagtggcacatattggctcagtgccacctccgtctccaaggttcaagcaattctcctgcctcagcctcccaagtagctgggagtagcccagcaccatacccaactaaattttatatttttactagagtggggtttctccatgttggccaggctggtctcgaactctcgacctcaggcgatccacccgcctcggcctcccagagtgctgggatcacaggcatgaaccatcgtgcctggcccacctttttccattgtctagatgccattgtatttcttggctcctggccccttcccctatcttcaaagccatcaatgttgcatctctctgtgctgtgtttccatagttgaatcttcctctgacacttcttcctccttctcagacttttaaacttccttgcgattacattggacccacctgtatcatctccccatctccagatccttaatgtcatcacatctgtgaaatcgcttttaccacgaattcacagactgattctggggattaggacgtgggtatgtttgaaggtcccttgttgtgcctaccacagactccaaggcatttactagagccacattttgctgacttgagctagatgtagcaaaagaagtgttataaaaatgggtttttaaaaaagcctttttttttcctgtggtataattttagtgtttagaagtaatttttcttttaatgcagtatgacacagaaaacatttggaggatgttgaaaagtaattgtttaaattggcaaagacacatttcagtaagggagtaaacaagagggaaacgtgttggggggaaaggtgtggggaggaaactctagaccagaggccctaggacttgaatatacaacttagtcctgttgaaaattcagattcctgggccttaaagtatgttaaataggtcaggggtggggcccaggagttgtacttttaacgagcaccctcctgtgattcatttaacataaaaggtccttggctcacacttggagaaacactgctgtagaaactcaaatacctattttaaaacaaaggtacattttaatcatttagtttaaaatgaaatcattgcataatactgatgttagaggttagaataaacatgtacttaagttcttgatattcttgtcatttcagttacatgtcagggaatgtgatttgtgttttgacgtattcaaatccttgtcatattcaaccatattcgtattcaaaatatataatgattttgacccttgattgttcgaattaagactgtcatcttttctgtgtgattaactcttgtgttgatataaatatgcctttggcttactaatgttcagtaagaactaatgactcttgggaatgttaatagactctgtgagtccctttttaatcatttgtaaccaggctgtcattccatgtttgtttggaagcttagagataacatttatgaactttgtgacacatagtagttgctcaataaatgttaactgtagaaacacattgattagtttcacttcagaaatagacacttagagttcaaaattcccatctgcctagctcctgaggcccactttcttaccagaatctttcctgataccctctcctgcataaaatggttcctcttttgagactttgtagctcttttgtacttctcttattctgttacgttactgcaaaaaaaaaaaaaaagaaagaaaagaaaagtgccaattgtgtacatgctttcctccctgctggaatgtaaactttgtaaaggcatgatccatagcagatacttcttattacaaactacctggcagaatttctttctaaagaacctactcagtaagcctgttggtgaactgagcaacatttggacaattatggcatcatcttacaatttttcagctattggttttcacttgtttagaaatgtaaaactttgcaaggacttttataaaagcaaatttcagaatagttattcactaagcttttttatgctaatgatgtcatgctatcaaaaattagctagagtaaatggactgtaatgaggatggtttgtaatctagattatatgttccacatgtaacatcgaaatgaaatataaaattgagttgttggcatgtggttgtggtgagcagaagcagttattatacattacttggtaaaattcatattcatatcttgtcagtttacagtgagccagagattaaaaataacatttgtttctgttttagtaactgcttaaaaatatccaaaatcattttattttctttagcctgacttctagtagtgttttgaatatgtggcctttcaagcagtaatgaaatgcatcaatgcgacttggcagtgcctcacaggacatgcttctaggatcatttttaatgattaaaagtcaaattgagttctaaaaaactgacccaaaatatagatgagccaagtaaaaacggaaggaaatctgaataaaatcttggttcttggtcctctgcatgtatcctccacatctgttttctccagatctcttttttcttgcttgttgatagcacagaggaagatcgcagagagtaatgtactgtatatgtttcacatcccccttcctctttagtgatagtttggagagtatactgcagtcaccatggttttcagtttggagagtacaaggatcagatctgtattttctagagccagcttttgtggcattctggagaggtgattggagaaccatgagagcaggcagacatctgggtgagagggcacgaggggtgagtgacggcagagccagacttgctggagaggcagaaagggaaggattcaagtagcataaccaggaaatagaattgataggatttggtccctgctgacctgtggaataagggggaaggcagaggagttgattctagtatttctaagttgggccacttagtgatattggggtaccaggaacaggcttagtggacccacagaagtgaccagacccaggagtctctctgagcgcccaccctggcttctctgtgttggcttaccctttcttggttgggggtcatggggtggtcagcttcagtggtgtggtctgaggtgacaggtgctcaggagtgaggacagggagtagacatcaccaatgtgaatgtggaggtaggcaacaagagttattctagaactgacaaatttaatatattttgctgactgctgagttccatttggacaaatacctaatgcatttggggcttaaaacctagatgacgggttgaagggtacaacaaaccaccgtgatacatgtatacttatgtaacaaacctgcacgttctgcacatttgtcccagaacttaaagtaaaaaaaaaaaaaaaaaaaaaagattgttcagttcagttcagagagcaataggagcagtttgctattcaccaaatagggacatcaattctttactgattaatagcagtgattcagaaaactgccttttgtagtagagcacaccaagggggtctgccggatggaaaaagagaacagtgctttgtgaactataattgttgccataagtaaatacttaaaatacactaaaatggcaacatcaggaaacatgactaaggagtcagtgtacgccacgccctttcccccacctttgtggttgttgaaaatttccaccaagagtgatgtatacaaaaaagggtaagatcagggtgttaggtttcagaggaaggcaaaaacttgtgtgattctataaatggagcttacaaatggaaatgcaccattcaaggcagaaagtctatcacagtcattaggaataagcattagagtgattctcctttcttaacttctgcacagaagtttgatgtggtaaagaaacagtctgctcttagccatgttccttgaaaatacatgtcttcaattacttggtttgtctgagagaaaggagggtttggaggagaaggaaatgcctcgtgagtttgacatactatgggaggattgttgttattattgcttgatttacatgctctcattttatacaaagtgtacagcacaatttctcaaagagtaattatgatgccaagaaaatggggtggattctgggcttcctgcagtctgtcatccaaataataatattcattacaaagatccttacccaggaggccaaggtgggaggattgcttgaggccaggagttcaagaccagactgggcaacatagacccctatctcaaaataaaataaagtaaataaaataaaataaaataaaaaataaaataaaataataaaagctccataccagtttgtggcattcctactgaaaacagaggtatacgaaatgcttgaacagggcatggaactggaggtatggatgtcattaagaatggctgagaattttttgccaagagttagtatactatcctactttattctatttcagtttgcagtaggacagacctaattctcttccctgagaaagtcacaaataaactagcatggagcttctcagtgggcacccttggctgaactctatagactcctgttctctttaataatatctaaagcttctggttcaattacatggctaatatcttgactctcaagaccaaaaggcaagatgtttaaaaataaaatcaacgttaaaaacatgcctgtgttccatggacacaggaaggggaacatcacacactggggcctgttgtggggttgggggaggggggagggatagcattaggagatatacctaatgctaaatgacgagttaatggttgcagcacaccaacatggcacatgtgtacatatgtaacaaacctgcacattgtgcacatgtaccctaaaactttagtaataaaaacaaaaaaataagaaaacaaaaacaaaaaaaacatgccagtgttctttagtcctcactcaattagagaaaaatgagagcaagcatgatattttgtatctggcactatgtgcactgccttgagagatttctctagaaggttttaagaacatctgtcatctattaatagttacgaaagccgagactcacacaaatgaggcaacattacagggggtcagagagcacataggtaagcccaccttgatgggagtcctggcccgaggcactttggggaaagagtgagctgcagtggttatagaaagacaaatgtcttgagccgggcattgaaaaatgactaagaataatctagaaagtgttcagtatgtttttaacgattgtgggttagcagaaggaaagccatctgaggtgagagaaataataagcaaaggggacagaggtggatggtgaatcaactgacccaagggagttaagcgtttagaaagcacttcaaaaggataacactacatagctccttgccttactgtggtgccttagagatgactggcatttttgcagagcttgtttcataaatgtgctttcagaggaataaacaggggattcgggctgggctgaggataccttgaattttgtttacagaccatcattttgtttacagaacatcagtgctctatcctcatgtccttctaagaatcaaaagttttaacctcacagaatccagcgtgtggcttgtgagtgagactcctttttccatgtgataaccggtctgctttggggaggcaaaagaatcttaccgacacgtacatattttaggatgggctctgagccaattcatcaagccaactcctcactttgaaacaagaaagtgaagaggatgtttcatgattgtggaatacctgccagaggaagaatctaccgaagttcagtcaactattaattggaaaggaggcagcagactgaggagatagagaatctttgctctcaggtggatggaggttggagtcctcaatctgtcacttgtgggtacattatgtagctccttcacctccatttctttatttattagaaggcgggtaataaaagtgtccactgcctaggatggttctagggcttagaggagataatgaaactcaagggcttaacatgtgaatgttagctattatcattgcatgtgtccattaacacccaaagataaccagtgttgtttagtagttctttgcgtattttctttctaaatagataatgatttataatttacctagttacttcatgaattgatttcatgaaaaaggtctttctgaatctctttccatgtactttaaaagtttattcctttagttaaaagaaattttaactagattcttaaagcctagattggaagaaagtgtttgctaaaaaaaaagtcatggctgggtgcagtggctcacacctgtaatgccagcactttgggagaccgaggcgaacggatcacaaagtcaggagagcaagaccatcctggccaacatggtgaaactccgtctctactataaatgcaaaaagtaactgagtgtggtggcatgtgccagtaatcccagctactcgggaggctgaggcaggagaatcactggaaccagggagtcagaggttgcagtgagctgagatcacagtactacactccagcctggtgacacagctagactccaaaaaaaaagaaagaaagaaaagaaaagtcatgtatatatccagaagaaaggaaatcagtatattgaagagatacctgcactcccatgtttgttgcagctattcattatagccaagatatggaatcaatctaagtctccatcaatgaaggaatggataaagaaaataaggtacatatacacagtggaatattattcagccatacaaaagaatgaaattctgtcatttgtaacaacatggctggaactggaagacgttatgttaagtaaaataagccaggcacagaaagacaaatatcacatattctcactcatatgagggagctaagaaacatgacgtcatggagacagagagtagaatgatggttagcagaggatggaaagggtagtgaggagggaggaataaagagaggttggttagtggctataaaaatatagttagatagtaggaataagagctagtgttcagtagcacaatagggcaacaatagttaacaataacttattgtatatttcaaaataactagaggaatgaatttggaatgtccctaacaaaaagaaatgaagtgatgggtatcccaaataccttgatttgaccattacacattgtgtgcttgtatcaaaaaatcacatgtacccaataaatatgcacaacgatcatgtacccataaaaataaaacaaaattaaaaatgcacacttctcacagtttcttgcctagtagaatccaagtaaatacagttttccgcccacagataactcttccctctggtgccctcatggtttatctcatgttcttgaccacatgggttaatggtctttgttaggttgtactcagtgatccccaagaggacaaatggtgggaattatggaaattgaggccagaaggaaacctagagttctgtgcttttacttccagtagggatctgtggggtttagaatgtctgcctggtcagcagttctcactttgggaacccccccacccccacccaagaccttttctggagggacatctgtaagatcaagattatttttatggtaatactaagacattatttacctattccattcccattctcttccatgtgtacagcggagtttttcagaggctatatgatgtgtgatgatattgtgtaatgaaatgtgtcaacttttggaagatttgcataattcactgaactaatataattttccaaatgaccagggtatgatgttacaaaatcatgcatagctaaagatccatccaaagttcaagatagactaatgaattttaatataaaagaatacttagagtttatttctatgcttcagattccatggtgctgctcccctttaagaaactaccacttattgagttttggtatgatataaaaaaagaatatccacaattgctgaaactattggccacatcttctccacatacttcaaccaaacaacatatcacagaaaactgaattcagaggcacagaagagaatttaaccattttccattaagccaggcattaaagagagctgcaaaaatctaaatggatctcactcttgtcactaacttttttgttctgaaaaatataattattttttcataaagatgttatttcatgtagtatgcaatgggtatattagtatttctattaaatgaactaatgaatattttacatttttctcaattttgcttctaatatggtataatagttgttaaatatgatctacctaatgaaaagttccttggggtcctcaataaattttaggagtatagaggaaactttatactcttaaaatttattgaggacccaaggagcttttaagtgtgaggaccaaaagtgtgaggaccactggcctagtctggtcagtgtctacaccctgtgtccactggtttcacctttcttctggaaaaagtgttctgtggtaaaatatattttgggcctagatgagtgctttctcccctcatagatttacaatacacatgaacatatgagaccctccaaagtctttcccaaatttatcccaacctttaaaaacaaattatcccaacctttttttatcctccttttaattttggcacaacataatgttccacaatggaatataacatcctatggaacgtaccggctggtatatgatatgggctgccctctttccgttaacaaaaaaattaaaagcaagacattttccttcaaatccatactttatttagagagaggcctataaaattcacttgcgaatctgattgactttcttaaaaaaacatactcttcattcattgtattatgccattttgcttatactctttgaagctgtttctacttctgtttccaaatgcatatgtttttttaaagctctgttttagacatttttgtgtgttaattagtagcatctgctccatgtgtcataagacaaagtaatttcatccccacaaaattgtccaaattgcaggttaagtggtagcagcctagctgttgagctgttactactgtttggtatttttaaatggcaaaaaataccttcggtgatgcatcacatgcctttaataaaacacagtcactttgggtaacagaaagatttagaaatggcagtgggttttgttgtatttctttttatgattctttctttccagtgctttagtttccattggttgtgggtacaatcctaagagtcagaccaaaataaagaatattccatcagtatggatcaaaaacatgttcctggccggacatgatgggtcacacctgtaatcccagctacttgggaggctgagctgggaggactgcttgagttgaggagttcgaggttgccgtgagctatgatcacaccactacactccagcctaagtgacagagcaagaccctgtctctaaataaataaataaataaataaataaataaataaaaaattaaaaaacatgctcctggctgctgcgtgatgagcatcatcttcctaagacatgagactgatacttgcaccacccagcaccagtttcttcccggcacagtgccattctaaatttgtattgaggcaggagtgcagcgagaatttctttctccttctgtatttcacatgtctatgccacagaaagaatagaaacatcttaatttgttataataattatagggacaatagtcactgtattttatataattcaaaagttctttttaaaaaattttttggtcttgccggttcctactgaaacacttcgtacagtttgaatccttagtgactttctattgccaactgaaaattgattttttcctatattaaaaaaaaatccagccgggcacggtggctcctgcctgtaatcctagcacttcgggaggccgaggtgggtggatcacctgaggtcaggagttagagaccagcctgaccaacatggtgaaaccccgtctctactaaagattaattagccaggcatggtggtggacgcctgtaatcccagctgcttgggaggctgaggcaggagaatcgcttgaacccgggaggcagaggttgcagcgagccgacattgcaccattgcactacagcctgggcaacaagagcaaaactccatttcaaaaaaaaaaaaaaaaaaaatccaaacagaaaatactgtggctatcttattcagtatcttgttcttttccttaccactgagtagtttcagggaaaaccctttacaattgcaaaaagacattcagtttataggactatttattacagcgttggcaaatggtgctggaaattctctaatagttaaatgacgcaaattaaccagactgaaatggaagaaccatactgaggttgctcttcaaacagcaagaggctacctttctgttttctttgacaactgaatatagcttatgatatagttaaggtatcaaagatgcaagaattgtagagctatgtggcaggttaagaagcctgatgaatggccgggtgcagtggcccacgcctgtaatcccagcactttgggaggccgagaccagcagatcacctgaggtcaagagttcaagaccagcctggccaacatggtgaaatcctgtctctactaaaaatacaaaaaattagctgggcgtggtggcgtgtgcctgtaatcccagctacttgggaggctgaggcaggagaattgcttgaacctgagaggcagaggttgcagtgagctgagaccacaccattgtactccagcctgggcaacaagagcaaaactctatttcaaaaaaaaaaaaaagaagtttgatgaagatgcagatgcttcattgcttgtgcaaattgtgtgattttagcatattctacagtggaaagtcaaatttcaggcatgcacacctaaagtaggaaaaatggttcttaaaggggtagtgtgatgcagggattaagaacctggtttctggagtcagatggcctgagtttgagtcccacctctaccatgtatgtgtgctgttgaacaggtgatttaacttctttggggctcagtttctcccactgtaaaaagtcatgtaaagttcccagaagagtgtttcatacattgtaactgtagtagttatctactgctgtgtaagtaattactccaaatcttagtggcttaaaacaacaagtgtttattatctctcagtttttctaagtgtgaatcactgcatatcatagctgggtgtctctagctccaagtctttcatgaggttgtagtcaagttgttaacctgggctgacgtttcatctgaaggatagggtgggggcggtagggatctgcttccaaatccactcacatagatgctagcaggcctcagtgatatgccatgtgggcccttccacaggactgcatcacagcctggcagtcagcctcccccaggtgagtaacccagaagaggatgcaagatcccaagatggaagccaccatcttcatgtaacccagtcttggaaatgatctcccattacctttgccacagtctgtttgctagaattgagtcactaaatccagtccacactcaagaaggctttacaagggcatgaattccaagaggtgggatcactggaagccatcctgcaggctgcttataacagtaacttgtgctttaatttatatccccttatggtctattcctgacaatcagaccaaatgagcccttaaaatgtaaggcagatcatgatactactgcattaaaaattatctctggtcttcccattttacttaaaagtcggtatctttacaatggcctacaaggcctttcatgcttataaaattatttttctatattttgtaaaataatatatatgtataataaatgctatatatgtatatttgtataaacacatgtttatatgtttagttatatatctagaatttattttccatatggtgtaagatagcaatctctttcgaaacgaagagccaggtttcccagcactatttattgattacaatacccttttcctgggccaggtgcggtggctcacatctgtaatcccagcactttgggaggtcaaagcgggtgaatcacgaggtcaggagttcaagaccagcctggccaacatggtgaaatcccgtctccactaaaaatacaaaaattagctgggtgtggtggtgggcacctatgatcctagctacttgggagcctgaggcaggagaattgcttgaaaccagaaggcagaggttgcagtgagctgagatcactccactgcactccagcctgggtgaaagagcaaaactctgtctcaaaaaaaaaaaaaaaaaaaaaaaaccaaaacaaaataaacctcttttttccctgagttgatattctactgagaacctgtttgtctcttattatgcaatctgtgtctaattgttgcatttttgaataaagatatacttagtgggtctagtaaatcatataagatagttgtgtttgttatgattttatttgatttgaaacattcaaatacatgtaaaaacaaattataattgagaattaattatggcaaacatttaataagttcctttatttgatagattaggaactaattttatttaaaaggccgtgacttacatttaaaagtccaattagctacaacattaagactaaaaagtatatttcatgactcccaggtcactgtttataggttgttgatatcccatactttgctgctgctgctgttgcttataactgttcagaaaattttcaccaaaatgtctatcaaattggaaaaccctctggagtgagatcctttttaaaatatagccaactttcacatatgcaggcatatctgtgaatgccctaggcccctgtgctttctcttctgctttttgggcttttggccttatctttgcttatgataacttcaaatggtaaacaagaagggataggtgacagagattaaacccaagccagtttgttttgttgattattattaacggtattgataaagagtttgctgaaagagggaagcatattgaaattattgcttaaaaagaagtgtgtagaattttcagttgttttcttttgataagagttgcctcatagctgttgtagtatgtgcaaatgaaggtcagcgataaatcacagaatgaatcacttccaactccttcacatctacagatataagtaagaatggaaaatattgtcacttagatgagtccttattttttttttctgtatgaatagtataaaccttacttttctggacacctagctttggcagctggtgaaggttgttaaagtaacaaatgggaccattctgcctctcccagatcgattttgctgcaagatagttgaaaataatataatccagaaatgaatttattttcttatggcaaaaacaaaacagaaagagagtactatgaggaagtatcatgctactggtaaatttttcaaactaaaaccgcattacatttcattaaatgagtttatgtccattaagcgtcaatgagcatgagtggttgaacccagaatccagtcaaagtacatattaactttctgtatgactttaaaaagaggtatgtcaacctccctgggtcagcaggttcctttgcagaagacattggaatgaaacgtcaaggacctcttccaattatagaatacctcgagatatgaagttggtaacaaataagagaaatgcagcaagatatttttagttaaaaaagaaaagattgatacaagccagtaacttgcagtgaacttgtttaaatcctcctcctctctccaaattctgtttttaccaagccggtaaagtaaagacagtttgtcatgctttgaacttcctggcttatgttgatttctatcagtatgttgccttacacatttgagtgggagctgagttacataaaactaataaaatccttacaaccccattttctgtgggtactgatagcatccaaaaaataaaaaaggcttttgccattttcaggcagttgttcctccggctagatggaaaattgaatggcattatctcaactcacatgtttaaacattaacggagagacactttctcctcctcaaaagtttttagtgttcccaggaatttaaccacagatagacacaactcctcaaacgtcccgaaaaaaaggttgactattccataaagtaatagttacagaaggctttcaaggaattagttattcacacagtaagcttctgaggcatacgagcatatcctctttcttacaacttggtcacttgatccaatctttgatgatcaccgtgggacctttggagatttatggagtttagggttacaagtatgatgtggccaccatactcagggaactggatgacagtcagccgatgggttttcaacatagatgaggatgagctcataaaaggctaaaaaaggaggcagacacctttggaagactgtttctaggctctcaaatggccattgtcaaaaaacaaacagtggggtggatttgactaagcatcagaagatgctttaacaacagcctgtgacaagtgagcgttaaaagctcacaaggcagaaaggaacttttcagagtgaccttgtcagacgaggttctaatgtgtaggctttatcagctgctctgagtgggggtaaagaggcatgcatattttaaacattcatttcatattcagtgtgtaaagtaactactgcttttcagcttgggtggagaaagtatttatcaagaatcacacaagggaaacccatgcattacctacttatagggcaaaatggaaaatgttctctctcttatgctttatcttttttgttccatcttaatagctctttatttaaaaagtattcacatcagttgattagtctgagtctttcatttgaagcaaactttcttcactttctgcccttgatactgcacatcagtctttaatcacttagacgtactgaatttttctttattcacatctttcaatcggtaaacttgaaattttgcaagtgcattcccactggtgtacattctgattttcaagacctgctacctcccccagtgtcatgcttgttttttttttctttctttcttccttcccacaccccacctccagtattttagggcaccttatgtagataagcagtgagatggcttcatcctgataattaacatgcttgtttgaggttatgaaatatacatttgagaaaggccagggatttccccctgaatatccactaactgcttgaagtggcattttcattctgacttggtattttgttttgtttgactgcagcatactggagcatagtgaaagagtctattttgaagcttcaaacttagtgctgctgcagaccaggaacaagagagaaagagtggatttcagcctgcacggatggtcttgaaacacaaatggtttttggtaagtcatccaaaagacttgacatcttttagctttaaatgtcatcgggcatcacttcactggtgtaccagaacttcttcttcaagcgtattgctatttctctacatcctaaataacaggacatttgaaaaaatgttgtcctagtgacagagcactgagagagcaaccgcatttactttatgtgtttgtttctgaaacttgcagaatagtatgatctgaatagaatgtatttgtggttagaaaaaagaacaaaagcaaaaacaaagcaaacccaaacaactaaacacacaaacagcaaataaactacatctaccagatactccattttagctgaaaacataagggattaatcgcacgagaggaagtagattcaatttaatggcaagttttttgcgtcttgtgatcaaatacagtcatgtgccacataatgaagtttcagtcaacgacagatcacacgtattacagtggtcccataagattataatactgggctgggtgtggtggctcacgcctgtaatcccagcactttgggaggccgaggcgcgcggatcacgaggtcaggagattgagatcatcctggctaacgcggtgaaaccctgtctctactaagaatacaaaaaaaaaattagccgggtgtagtggcgggcgcttgtagtcccagctacttgggaggctgaggcagcagaatggcgtgaacctgggaggcagagcttgcagtgagccgagattgcaccactgcactccagcctgggcgacagagcgagactccatctcaaaaaaaaaaaaaaaaaaaagattataatactgtattttggttgtaccttttctatgtttagatgtgtttagaggcacaaatgcctaccattgtgttacagttgcctacagtattcactacagtagcatgccgtccaggtttgtagcctaggagcaataagctataccgtatagcgcaggcgtgtagtagggtgtaccatccaggcctgtgaaagtactctgtgatgttgcacagtgacaaagtcacctaacaatgcatttctcagagcatatccctgtcattaaatgatgcatgactattgtgatgggcaaggtgaaagatgatgggggtttccaagtcctgttcagcaaacatttactgagtaacttttaagtatacatgggcccttgaatgacagtcttagtctgggggttggaattcaaacactctaaactataaataaatgataaaaccattccagagcatacaccaacataatgtggacttccaggaattttttttttatcaaccccgttcatgatattacctggaagcagagtcctcaaattgaagcctaggtctgccccacctatcttggtcaccttggagaacttgctcatcatcttggaacgacttgcctttaaagatgtatgtgcctaactgatctccaaggtctcctgcaaatttataattcagttccctctagtgcaatgaattaaataattatccacttcagttcttgcccaacagaatttctgtgtaggcttggtggtcatttgcagaggggctcattgtatcaaccagtgtggaggaaaggagccaggtcctcggggggtccctcctggccccatttgcccatttgacagccagccctttggtcaaacaggactgtcagcatctgcagtaaataatttttttgttttttttttttttgagatggagtcttgctctgtcaccaggctggagtgcagtggcacagtctcagttcactgcaacctccacctcccaggttcaagcgattctcctgcctcaacctcccgagtagctgggactacagatgcgtgccaccatgcccagctaatttttgtatttttagtagagctggggtttcaccatgttagccaggatggtctcgatctcctcacctcaggtgatccgcctgcctcagcctcccaaagtgctgggattacagatgtgaaccactgcacccggcccgcagtaaataatttattcccttgcaacattaaaaaaaaatgtggcacagtgctttatgaatattatattcatttttatgtatttaattttaatttatttatttatttatttatttgagacggggtttctttctctttgttgcccaggctggactgcagtggtgcaatcgtagcttgtgctgggaccatatgagactgggactatcctggctgtcattcataaagtcttcactgaatttttaggacttcgctgactggtctctctttatgaacttctgtcacatttagggcctgcatcatataaaatgcactgctatgtgttgttctgttagtgtttgtcatcacgccatcaggggtacacacagcttcagggcaggaatcatcatcacagaccagtagccgagactacaggcacgcgccaccatgcctggctaatttttccatttttttgtagatacgaggtctcgctatgttgtccagactggtctggaactcctgggctccagcaatcatcctgccttggcctctcaaagtgctgggattacaggcatgcaccactgtgcctggcctgaatattatatccaaataagtgagataggcttcttttgaaatactgtcctttgtttttctttaggggatctgactttttccttctctgtgcttgccgtcattgtgttactggttaccggccagcctgttaaccctgtggatccccacactttgttttacgttgaatagcatttattattgttctttcttactaaacatcccctttctgaagcagagcttcagaaatgatgctcagatgtcactcttgttagcagctggctttctgccttcaagtgatgcattattggggtttcataacagcatttttttttctcttacaaatattaaattatgaagtgcaggaaaccacatgaatgtggtagaaagcaaatgcaaacacagtgttatctggaagtgctagttttgtgattctcctggtgacagtatccttcctgtaatcaacataggaaccctctttacctgtttgctggtggttttctatcctgtatcttcctctccatttatgctgtatgccatggccactttgtcatgctgaatcgggaggtttgattaagacagttgcttggggactatctctatcaaagttctgcctcaccacaaatcctggctgtcacttacaaagtcttccctgaatcctcaggacttcactgactggtctctctctctctctctttttttttttttttttttttttttaaggcagagtcttgggtctgttgctaggctggagtgcagtggcaatcttggctcactgcaaccttcgcctcccaggttcaagcaattctcttgcctcagcctcctgagtagctgggattacaggcatgcgccaccgtgcccagctaatttttctatttttagtagaaatggggtttcaccatgttggccaggatggtcttgatctcttgatctcatgatccatctgccttggccttccaaagtgctgagattacaggtgtaagccactgcgcccggccctgagcagtctctctttatgaacttctatcacatttagggcctgcttcttacagaatgtactgctgtgcattactctgtgagtgtttgccatcagcacaattgcacatgggttgcacatggcttcaaggcaggaatcaaatcacagaccagtgtttcccaagggtggtctaatcccagtacctcctgcttccgaatctcttggatatgtttattaaagttgcagattcagcaacaccaggcttatgaatcagaagttctggggatgtagaacccaggaaactcaccttagttaacttttgcacactgaggtttgagaataactatctgaaaataattgtgcatcctcctctttgcctcctctcccacagcaaagggtccaggtctgagcctatggtaggtgtccaggaaatatttgcttgttgacctaagcaacatcaagccatgagggttgcattccctcttcagttgccaagctttttcaggatgtgaggtcagcatattctctgaacctttagaaacccactttcttccaaatacgtaaagtgttcccctagggcagaggctcttttggaaatctttttttgtctctttatcttttgtaatcactaactctgttggtggtaatgacaggagcccctgactaagattgggatagtggggacatcagctatgaggagctgggctggagcagcaggctaggagaaagatctgaggataggaaccggactgtgctaaactagaagctttatccttggctcccaaagccacacctgctacccttggcagtttattctgagtggtatttctttcagctgttaggcctcgcaggttgtcagttttggtggcagaagagcggtcccgctgctgaaaaggatcaagtttagctctagtggacgcacatcaaagcacctacagtgcacagtggtggattcaggatttgaatccaatgttagcagactgcagtggtgacacttggccctctccttccgtccgcctcttgttccagcaagggcatgcctggtcttggatgatccaggagagatttgcagggcgttgctgcttctggtgcacctcctgaatgcccttgctggtggctccagccctggtagatggaatccaaacagaagaactcacagaagcttagctagcctagaaaggaaccagcgtggccatcaggacatttattagctgttaatctaaccactaccaaatgcattaacacattttttttgacaactttttctcttttatttggctgttgcttagttcagttttgcttggagaagttgtggcaatcctgaattcagtttgtgtgaaaaagcaagcaccttcaagcccagtgttggagaagtatcttctcccaggtctctattcagttttgactaaaggaggtttggcgagcagaaaggtattaccgagtggattcttctcaaattctcatctaagtgaaggaaaaaagcccagtttgctgaagccatgttaagggcacattaggcttttaatatgtgcttcatggagaccttactagattttcctctgcgtagttctttccatctgatgggagcgagggctgtttttgggttgcagaaggcaagagccaggttgtcagctacagaagagaaaggtgccattgtctgcataattgactttgagcctttgtctaaaaggatgtcaggtggaggagtaatgaggggcgagatttttaaaaaattatagagtacaggattttagcaaaatgccagatgttggcatttctgttttggaggtctttagtggtccatgtaaactatttccttgcaagtaaccatccatggtaggaaaacagaaaaaaatgattctaaaagagcatttgtctagttagaaactgtgtcacttgtatcgtttaccgtgaggcatccttgagaggtacatgatttccaaacagccacctaaatcataggtactgcttttggaacagatgtaaataggaaaagcgccagtccagtacccccactaaagaccatcgttagaaagctctcgcagtgctttccagcttagaggagtgtagttcccttcaggtacttaagccagtgttcggtaaagcagcacccaaaatgccttttgttaaatgtgttctaactcgttcctcttgctgatgctatcacaggctaatgattgtctaagtccttcagagaagctgtgtggttttgtatagctgtgagtaaaaccacacccattcaggaaatgcaatgtactttcttctaacaggcatcatcaaaacagatgctgatttacatggtaggtccccttctttagtgacaatttgagagctttgaagggaggcatttgccgtgcatcagaagaaatcagaattaaactggcacacgtgcacattgttggagtaaaaaggaaaagcagtgacctagagtttgttaccgcacatgctttccctgaaggcatctgcaccatcatgatgtcctcatcaactctgcacacacaactagtatttctgtctctttctcttcagagtttaagctcaatgatttccaacttcctcccacatgactccagctggatatcacataggtgtcttcaatttgaatctaaacctgactttgtcattgtcctacgtttatgggctccagggtcactagctcaccatttgttgatgctggacacctcctcttcctctgcttcatccctagctcatatgctggagttctgccttttttttttttttgagacagagtctctctctgtcacccacgctggagtgcagtggcaccatctcagcttactgcaacctctgcttcccaggttcaagggattctcctgcctcagcctcctgagtagcttggattacaggtgcgcaccaccacacctggctaattttttgtatttttggtagagatggggtttcaccatgttggtcaggttggtctcaaactcctgacctcatgatccgcctgcctaagcctcccaaagtgttgggattacaggcgtgagccactgcccccagtctgagtttggcctctttaatatgatagtttacccactcttctccactctcgggcccctgttctgttgcagaccttcagcatcacttgcctggactgctgcagtggcttccaagaagccccttgcttaaagtcttttctttctgtgttccatttattctactcttttgagaattctcatatgaaagaaagggtctgattgaattactcctacacttgaaaatccttggtagtatgtggaaatatggaaaagtactcataatctaatgtgttaaaagaaaaactttagacaaattaaatttaacagagtttaattcagcaaagaactatttgcaaatcaggcagctcctctctactcctttcctcccgaactagaatagattcagggcatttctgacatgctgttgtgtggttggagaggatttatagacagaaaaaggaaaacgacggacagaaaacagaagtgaggtacagaaacagccagattggtttcagctcagcgttcgccttatttgaacagggtttgaacgataggctgcctgtgattcgccgaaacccagagattggtacaagaataggttacagcctgtttacacatccaggtaggttacggttcactgcatgcggagaaacctttaggccaaacttaaaatatggaagaaggcagctttcggctaaacccaacaaatgttaagtataaaattcatatttcaaaattgtgcaaacacattgattacaaagcagtgacaaaaatctatgcctatccacaaaggctagaagtaaagaaaacaagaatgaaggtatttttaatattagggcaattcatgtgtgtgtgtgttttttaatactcctttggtagcaaatgaatatggtgaagtaaaatgaataattgaaaggattttgttagctttctgctcctgataaggtaaaatgtgaatttcactgcatggcctctaaggcccctaggaattccttatcaacttaccatttaaatctcatctcccgtgactcccatcccttccatctctccatataatatttgttttcttcttaaacatactatgtatataataaccatgcacctgtccctgttgtttcttctcgcatgagactcttgttctctgcctggtaaactcccactcattcgttgaggcctaattgaaattcctggccaagcatggtgtctcacatctgtaatgtcagcattttgagaggctgagggaagaggatttcttgagcccagaaagtttagactgcaccattccactccagcctgggcaacagatagagagctcgtctcaaggaaaaaaaaaaacaaaacagaaattatcctcttgctgtgttaccgctattatattgcaattttctgctcatatagctatcttggtaaatgattcatgaagacagaaattgacttatcttaaaccttgtattccaagtgttaagcccattcctgcatataatacagtttaataaatatttacaaaggtaagaagaaaggaaagagcccatttagaaatacagaaataatccttcaggtaagatattaaaaatgtttttggataagcttagtactaattactatttcataaaaattacaaaaatagatgtttttggttaaacagtttttacagtaatagttggattcagcctcacatcatttaaactaaactactggcgtatatctttggcattagaaaattctaacatcagatagaattgcttcagcttcactgtaagccatatttatgaagttactaaaaaccatttttttaaactgttttatgtcatgcataaccatgtcggccaaatcagaaatccaaataaatgacacatccagttctggccacattttgtgaatatctggtatttttttcttaagggaatttaaaaagactgggtaacattaaagggttgatgtaacattttcaattctgaaaggctactctgctctaggaatatacttgttactattttttttttcatttctaagaattctgtttggctaaaataccaaaagagaaaaaaataacttggcttaaataaaatgaaaagtcatctccaaaattaattcggctcctcaaaagttctttccaaaggaaggaataggatgctatttaatattacatgtcaaaaacaccactaaaaagaaaatcatcatttgtacgtgtgacaaggaattcagaatggaattttatgaaggctagtgtgtgaggcacgctgctcacatcttttaaaataatattttgatatcggggaagattatttaatactatatattattttatattatatatgtatgcatatgtgtatatacatatataaaatagagttttttcctattaatgctttagagtcaataagttgtaatggggaatttcagtttgagatttgtcattttttttgcatgatagccttgcccagccttcagttttcttgtttataaagtcatgccaaaaggtgaactgtcactggattaactaattaagaaattagtcagtcactaacatttattgattgaccactgattggaaacattaaatacccacatcattttttagcatttcatgtaagttgatccttgtctgttttgcagagtaaagaaccttagctgaatttcatttttgtctgtcctgatctttgcattcatttaaaaacctgacccttcagctgtttacaagatccatcatgaaatataccatggctaaggtgaatgtgcagactcccagtttccctttagctattctgttgcactagccatggggttgcaaacttttttggtgactgttacagttcattcatcaggaggtactgactatattttgttgcactttcatgagagccagggctcagaagcatcctaagtacctagtgacaaaaactcaggaaggcaattagactatgacgcttttcattacaacctaaggtgcctctcaatatagtaggtgcttatgttgaactgccctctgcagactgtatgtgtgggtccatgtggtgatattgtggctgtaccctctccaaggttgcctagtgttggctgtagcaggaaaggaagtgtctgtaagcaatagtagcttcaatgaggaaggatataaaagagaagtgaactagtcctgaaatcttaaggatctacatacagaccagagtaccttgatggatcccaaagttttattttattttattttgtttttgagatggagtttcgttcttgttgcccaggctggagtgcaatagcgcaatttcggctcactgcagcctccgcctcctgggttcaagagatcttctgcctcagcctcccaagtagctgggattacaggcacctgccactacacccagataatttttgtatttttagtagagagggggtctcaccgtattggccaggatggcctcaaactcctgacctcagatgatccacccgtctcagcctcccaaagtgctgggattacaggcgtgagccactgcgcccggccttattttatttttccagcattattgagttatgattgacaaaatttgtgtacaacacgatgctttgatatacatatatattgtgaaatgtttattatcatcaagttagttaacactttcatcacctcacatagttattttttcttgcatggtgagaacatttaagatttactgtctcagcaaatttcaagtgtacaaatatcattattaaccatagtcactgtgctgtatattcaatccccagatctcaaagatttaaaatctagccctgagacaactgattacagccaccatatgttttcttaggtagttcacaataaatagttataatgctgctgagaaacagtatgatgtgttgaaaagtgtaggttcttgaggcaaacttcctgggtttgaataccgaacttccacttaatggctgtgtaatgttgagcaagtgacttaatctctttgggtctcagtttatcaatccatgaaataagaaaaataaaacaggccaggcacggtggctcacgcctgtaatcccagcactttgggaggccatggtgggtggatcacaaggtcaggggttaagaccaccctggccaatatggtgaaaccccatctctactaaaaatataaaaattagccgggcgtggtggcaggtgcctgtagtcccagctacttgggcgtctgagacaggagaattgcttgaacctgggaggtggaggttgcagtgagccgagatggtgccactgcattccagcctgggtgacagagcgagacttcttctcaaaaaaaacaaaacaaacaaacaaacaaacaaaaaaacctaaatgagtcttgatgcacgtaaagctttcaaaaaatggtagctgttattatcataccactttcatggaatttcgttagttactcagtttgtggtaaaatttttccagtgtttattcttcatgccttcctacaaacttggtttaggaatttacactgttaggggaaacatgtaggtgaacccagctagggaaggcgaagcaatgctgtgggaacacaaaggagtgggatatttagtctgatttgggagtggtgaggacttggaggaagcatcagagctgacttggaagaatggctaggattccacctgacagagctgggagcaaggcattccacacgggagggcgtgtgcccaaaggtgtggagaagggagagtgcagagcagagcatatttgaggaaagctgtggaccagtttgagcccagggttaaggtgtgtgaggtggaacagtgggagactgggaggaagatagtctgatttaatgataatgatgataacggtgagtgtgaactattcactgagtggtgccatatatcagattctgtggttggggctttacataaattagctctgattacaactcccttcaacatagctatccacattttacagatgagaaaatgggattaattccattttttcttaagtggcggagagccactgaaggttgttgaataggagagggtcatgatcactcttagcaggaatttacttatctgctttttcacttccctggagtggtagacacgtcttttgttttgtttaagagacagagtcttgctctgtcacccaggctgagtacagtggtatcatcatagctcactgcatccttgacctcctgagcccaggtgatcctcccaccccaacttcccagagctctggaattagaggcatgtgccaccacacctggctcatttttaattttttttttgtagagatggattcttgctatgttacccaggctgttctggagccctgtgttccagcaattctcctgctttggcctctcagagtgctgggattatgggcatgtgccaccacacatagccttggagatacatcttgcaccatcctgggctccccagaggagtggtattagactgtcagtatggtgaatactccataaatactggtggagtctgttttcaaagcttccttaacaaaactctggaaacatgttttgtacaatttcctttttaaagaagaaataaactggttaagttactgagcaactcctttttgcctgtgcatgtttcatctcatttgatccccataggaaatcttaaaggtagagagtgtaatttttgcatttcaattatatgttattaatattataatggatgaggtcactgggactgaagaaagtaatgctgcttggagatggtaaagctgggattcaatctgtggctccctcacccttggtctgtagtcggccaccacccctccctctattgaacctctcttttattgctgttttccagtctccactaagtatttcttccactggtttaagtccacgttgctaagcaagtacacagttgcttttaaggaaacgaaagccccacaaggacccagtctactttgcagaggttaaatggaaatagattattttcaataatctgtcctcaggaccagaattcttctaaatgatgctgctggcagctggccatctctgggagcccatcagacaaaccacttgtaggagcccagcatcctgcattgggtcagaatgcaaagtcaactaactcttcacagtagatgcagtttgggcgtgagtacctagcaggaaccctagatatttggggcaagcactttgcttcttccatctggtggaacccacgtttattatctaaaagacacatggcaacaggcaatgcagtgtttgcttccaaagacagcctggaatttggaatgacatttagtgaaaggggaaagttcaatttcagctatcaaaggtcatggccagtgaacctacaagcacatattatgtaaatttggcccaaatctgtatttattagcttgaacagttttggagtggttatctgctctacaaaaatgatctaccgttaagagtctcaaaaatatcaagtctgcttgatgcatttaaatcaggaagcgtaaatatttggcatccatgctagtgctgattttcagaggctttgctcacctgcagctgtgctcactttgcgaaaatggacatggtgacctctactttcctggtgagtggccacgtcagtatcatcccttcccgttcctggcaccactctcacccactttggagagccagcatagagcagcacgctgtgtctcagggaccaggctatccatcagataccctactctgaaagtgtccttaatttgatttttaaaatatatataaatatatagtgtgtgtgtatacacacacacacacacacacacaccataaaatttaccataaatttaccattttaacctttttttttttttttttgaaacggagtcttgctctgtcgccaggctggagtgcagtggcatgatctcagctcactgcagcctccgcctcctgggttcaagcaattctcctgcctcggcctcccgagtagctgggactacaggcgcatgccgccacgcccagggaatttttgtatttttagtagagatggggtttcaccatgttggccaggatggtctcgatctcttgacctcgtgatctgcccgcctcagcctcccaaagtgctggggcgtgagccaccacacctggcccagtttaaccatttttaagtgtacaattcagtggcattatgtacatttccagtgtagtgcaatcatctccactatccatttccagaactttttcatcatcccgaacagaagctctgcattcattagacaataacactccattctctcctcccagcccctggtaacctctattgtacactgtgtctctatgaagtttcttattttagggaccacatggaatcatacaatatttgtccttttatgtctggcccataatttaatttttaataacagtgtttcaaatatactgttcttttccaaagtatttgttatcaatactttattatgtcagtaattatcaataagttctcattctaatttcagaaactgggttgtattggaatatgggcatagagaagatacagatttttttttcttcttaataactgaagagaataacatttatcaaacaaacgatcgaactctttctgagacatagtttcatgtgcctctttggagttgatttcccctcactttattttaactcctatttggcccgaattcttctcagaatttctgcaagcaggctcatagtcctgcgttcttctcttctctttttttttttttttttttttggcagggtctcactcttgtctcccaggctggagtgcagtggtgcaatctcagctcactgcagcctcgacctccgggcctcaagtgatcttcctgcctcagcctcccaagtagctgagattacatgtgtgcacgacaacacctggctaatttttgtattttttgtagagacgaggtttcatcatgttgcccaggcttgtcttaaactcctgggctcaagcagtctacccgtcttggcctctcaaagtgctggaattacaggcgtgagccaccgcagctggccaggcttacatttctgtagtgcctgttaggaagagttcagaattttttagacacaggcatagctcagagatattgtgtcttttttttttttttttgagttgggagtcttgctttgttgccaggctggagtgcagtggcacgatctctgctcactgcaagctccgcctcctgggttcaagcctcccaagtagctgggactataggtgcctgccaccatgcccagctaatttttgtatttttagtagagatggggtttcaccatattggtgaggctggtctcgaactcctgaccccaggtgatccacccacctcagcctcccaaagtgctgggattacaggcatgagccactgtgcctggacactcagagatattttgggttcacttatagaccacagcagtaaagcaagtattgcaatacagcaaatcacacaaattttttggttttccagtgcatataagttatgtttacaccatactatagtctattaattatccaataacattttgtctaaacaaaagtacataccttaattttaaaatgctttattgctaaaaactgttaacgatcatcttcattgaaccataatcgttttgttggtaaagggtctttacgttgatggctgctgactgatttagggaggtggttgctgaaagctggggtggcggtggcaatttcttaaaattagacaacaatgacgtttgccacatttattgactcttcctttcatgaaagatttctctgtagtatgcaccattgtttgagagcattttacccatagtagaactttcaaagttagagtcagtcctctcaaacctgtcactgcatcaattaagtttatgtaatatttcaaatcctttgttgtcattttaacagtgttcacagtatcttcatcaggagtagattacatctcatgaaaccactggtttttttgtttgtttgtttgtttgttttgagacggagtctcgttctgtcacccaggctggagtgcagtggcgcgatctcggctcactgcaacctccacctcccaggttcaaacaattctcctgcctcagcctcctgagtagctgggactacaggtgcgcaccaccacgctgggctaattttttgtatttttagtagagatgggtttcacaatgttagctgtgttagccaggatggcctctatctccggaccttgtgattcccctgcctcggcctcccaaagtgctgagattacaagcgtgagccactgtgcccggccatgaaaccactttctttgctcctccatagaggcaactcctcatctgctgaagtttgatcatgagattgcagcaatcaattcagtcacattttcaggctccatttctaattctggttctcttgctgtttccacctcatctgcagttccttcctccaccgaagtcttgaaaccctcaagtcatccatgggggttggaatcaacttcttccaaactgatgttcatgttgatattttgacctcttcccatgaatcaaatgttcttaatgacatctacaatggtgaatcctttccaggaggttttcaatttacttttcccagatccatcagaggaattactttctgtggcaatgatagccttacagaatgtatttcttaaataagaagacttgaaaataaaaattactccttgatccatgggttgcagaatgggtgttgtgttagcaggcgtgaaaacgacatgaatctccttgtatatttccatcagagctcttagatgagtgacgaagtgcattgtcaataagcagtaatattttgaaaggaatctttttctgagcaattaagtctcaacagtgggcttaaagtatttagtaacccaatgtgctttcatccaggctttgttgttccatttctatagcactggcagagtagattcagcataattattagggctctaggatttttggaatggtaaatgagcattggcttcaactaaagtcactagctgcatttgcccgtaacaagagagtcagcctctcctttgaagctttgtagtcaagcattgacttctcctctctagctatgaaagtcttaaatggcattttcttccaatagaaggctgctttgcctacgttgaaaaatctgtagtcaccttcatcaatgatcttagttaaattttctggataacctgctgcagcttctacatcagcatttggagaagatttctttccttaaatctcacgaaccaacttctgctagcttcaaacttttcttctccaagttcctcacctctctcagccttcatagaagtgaagagagttagggccttgatctggattaggctttggcttaagggaatgtatggctggtttgcttttctattcagaccactctaactttgtccatatcagcaacaaggctgtttcactttcttaccattgatgagttcactggagtagcacttttaattttcttcaagaacttttccttagcattcacagcttggctaacccttcagtcacaagaagcctggcttttgacatatgtcagctttcaacatgccttcctcgctaagcttaatcatttctagttttcttatttaaattgagaggtatgtgactcactcttcctttcacttgaatgcttagcggctattttagggttattaattggcctaatttcaatattcttttttttttttcttttttgagacagagtctcgctctgtcacccaggcttgagtgcagtggcacgatctctgcttactgcaagctccgcctcccgggttcacgccattctcctgcctcagcctcccgaatagctgagactacaggcacccgccactacgtccggctaactttttgtatttttagtagagattgagtttcaccatgttagccaggatggtcttgatctcctgaactcgtgatctgcccaccttggcctcccaaagtgctgggattacaggcgtgagcccccgtgcctggccaacttcaatattcttgtgtctgaggaaacaaggaggcccgagaggagggagagagaacagccagtctttgtagcagtcagaacacacatgacatttactgattaagttcattaccttatatggggtgtgtggttcatggtgaacaaaacaattataatagtaacgtcaaagagcactgatctcagatcaccataacagatataacagcgcaaaagtttgaaatactgtattaccgaaatgtggcagaggctcaacatgagcacatgctgttggagaggtgatgctggtggagttgcttgacacggggttgccacagaacttcaatttgaaaaaaaaatgcagtatctgcaaaggacaacaaagtgaaatgcaataaaatgagatgcgcctgttgcatctttcaactgatgtgtcctttcttttcattaaaaaaaaataacgttctgtccatctgcctctgtccaacaacaggcagtcacatgtgatgcctactgttggagaattggtgaatcataggcctccacttctggtgctattactcagagaagaagtatttctttctgcatagaaggaaacattgtaattttactgcagcaatgaaattgtagtagaggtgaacataattcttctatttacatctttaatgagccacaattaaaagtagtgagttggcatgtcagagtgaatgtgttattttcagatttctgttagaacaatggctgctgctggttgaagctgcacttccctggccccttggagctccaaaagccttaagaaagaaacccaggggccgggcgcaatggctcaggcctgtaatcccagcaccttgggaagctgaggcaggcgaatcacctgaggttgggagttcaagaaccagcctgaccaacatggagaaaccccatctctactaaaaatacaaaattagccgggtgtggtggggcatgcctgtaatcccagctacttaggcggctgaggcaggagaatcgcttgaacctaggaggtggaggttgcggtgagcctgtgtctggagttggttccttccgataggtttgtggtcttgctgacttcaagaatggagccacggaccttcacagtgagtgttacagctcttaaagatggtagggacccaaagagcgagcagtagcaagatttattgtgaggagcgaaagaacaaaccttccacagcgtggaaggggacccgagcgggttgtctctgctggctggcgtggccagcttttattcccttatttgtccctgcccatgtcctgctgattggtccattctacagagcactgattggtccattttacagagtgctgattggtccattttacaaacctcaagctagctacagagcgctgattggtgtgtttttacagagcactcattggtgcattttacaatccccttgtaagacagaaaagttctccaagtccccactcgacccaagaagtccagctggcttcacctctcaataccacttctgcatttaattatagccaccgactagctgcactatgatattaatctgggctacttgcttaggaacctgcagatgggtttccataagctagacattgctgcctgataaatgactgtgggatacaggttttcctgatgaggtagtaaagccacatattggaattcatttaacagctcgacaacataatttgtaaacatttctatttagtcacgtgtactcagcaaaaatgtatactaaagtgtttaccatatacttggcattgaagggaattataatgaaatatgttgatcttggtcatttataggtgttcccaccactgtgatgtgtgcatgcattgtgggccaggaggttttatctggaagctagtgacacttcagcgtcaaggcgtctcgctcctgcaggccctttgtaagaccctgtacctaattttatgttgataattttgtgcagtttttttttttttttttttttttgaggcagcgtctagctctgtcatccaggctggattgcagtgttgtgatcttggctcactgcagcctcaacctcccaggctcaagtgatcctcccacctgagccttctgagtagctgtgagcagatacatatgccaccatgctcagctaatttttgtatttttttgtagagatgggggtctcactatgttgcccagttttgtcttgaactcctgggctcaagcgatcctccacttcagcctcccaaagttctgggattacaggcgtgagtgaccatggctggcctttgagatcttttcttaaagaccctaacaccccatacacactcctctaccccttgactagttttataaactgcagacctcacagactggatccacccctgattatgaatatgtttaaactgtgcatatgtatgcattaattaaaacatatttatttctctttcatactagtatgtgaaattccaaaaaatctgctagcccacaaattaggaaaattaaagggctatgcctacctctgccagctgtttccaaggaaatttatatcttggacatttggcagataataatatcatgtttgactgatagtgatcatgtcctaaatttcccaaactgatgagtcacaatcgtgattcacatatttctgggaatcgccccccaacaacttgcgatttgcctggcgtagctgtagtatatcagagttttttaggtgtttagcagaactgaactatatagcttcttgtcccatgccaattcaagaaaattaatttaatagctattttatgaaacattttttcctaactcgacatggatattttaaggtgattttccctgctaagaattcacttgttataggtgactctaattggagaaacagctgttgacttctagtgtgctcaattagtttctttcttcctttttctttttttattttattttatttattttttattatactttaagttctagggtacatgtgcacaatgtgcaggtttgttacatatgtatacatgtatcatgttggtgtgctgcacccattaactcatcatttacattaggtatatctcctaaagctttccctcccccctccccccactccatgacaggccccggtgtgcgatgttccccttcctgtgaccaagtgttctcattgttcaattcccacctatgagtgagaacatgcggtgtttggttttttgtccttgcgataatttgctgagaatgatggtttccagcttcatccatgtcccaacaaaggacatgaactcatccttttttatggctacatagtattccatggtgtatatgtgccacattttcttaatccagtctatcattgatggacatttgggttggttccaagtctttgctattgtgaatagtgccgcaataaacatacgtgcgcatgtgcctttatagcagcatgatttataatcctttgggtatatccccagtaatgggatggctgggtcaaatggtatttctagttctagatccttgaggaatcgccacactgtcttccacaatggttgaactagtttgcaggcccaccaacagtgtaaaagtgttcctatttctccactttcttcctttttcaaagagttcctttattattcccaggccgtcgttaggtgtaaaagctaatttagtttagattattttttaaagtgcacctggcattcaagctatgacatttcctgttgaaacagcactgctatgacctgggaagaaaagatcccaagaaaatataactgaggaatcaaatatttgtctgtataaaaggtttcatattaattcatgataccatttattagtcacttaccttttatgttagtagccataaggaggtgtgatggcatagactattcagggcgaatgacagttgtcatgggcagaaggtgcccatgcatcaggcagagcagggtgaccacaaagtggggagtggccaaatatactttgtcctactcaagacatgagggcctgtcccagtggcttgcttgagaacaaagctcatcctgatgactcagcagccacagtgaagggctgcctgggggctgggggagaaacaagtaggcagatgaggtccagttggaaactaaattgctttgggaggaggagagtggtcacacaatgtaggtttcagttccggctgcactgctaattttgtaaccttgggaaagttaccaacctctctggaatctcagtttcctcccctatgaagaagaaagcagtagcccagatcatccttggaggttccttcccttcagctgtgacattttgcatttgaaagagtaagagaagtcacaggaccatgggaaaggaaaacagaaatgatgtaagggaggcaggtcatggggagggtggtcaggaacacaggttggaagtgcccgtggtgtcaattcaggtgttcggtgatctccacgggcgagtgacttttattgggagaactgtgcactgcctgaggttagggttgtgctctggggaaaccggaaccttgaaaacaccttgtagggagccgcgtttcccttgcacggactgtgctgcctgtgcttccccagcacagtgggcgtcgtcgctttgtgtttgtgctggctgctgtgcggggttgcctgcctccccagcccacacctgctcagccttcctccactcatgttttcaggatgcttttggatgcttctggctacagtggattttccttctccttctgaagcccttttgaaattatttctctgcagattcagacatatttatttatctggtcaatgtcctgcctaaagaatcagataacgactgtgtttttgcctgaactcacacatatgaatgagcttttgtaagcggcagcagcagtgtaggtttagttggagctgtctgagcccttgtcaggttgctacttagttgtttagttagctctcgttgaacttctgtcacatcctcagtttctgggcagtgtgtaagaagagctccttctctctagaccagtggtccctaacctttttggcaccagggactggtttcatggaagacagtttttccacagactagggtggagcgggggatggttttgggatgattcaaatgcatttatattcattgtgcactttatttatattattatgttgtaatatataatgaaataattatgcaactcaccataatgtagaatcagtgagatccttgagcttgttttcctgcaacaaaacggtcccatctaggggtgatgggagacagtgacagatcatcaggcattagattctcataaagagggtgcaacctacatccctcacatgtgcagttcacaatagggttcacgctcctatgagaatctcatgccgttgctgacctgacaggaggcagagctcaggtggtaatttgaacaatggggagtggctgtaaatacagatgaagctttgctcattcgcctactgctcacctcctgttgtgcaggaggtctgtagcccaggggttgggaacccctgctctagagcttaataatcaactggtggagaccagtgcaattgtaaacaaaagtgacaaaacgatagtaataatgccaatggtaatgaaagctacagacattttcagagtgctgtgtctccaagtactgagctgagcactctgcactcatgaaatatgtatcctcctcacacacacacacgcaaaataaatgtttaatggaatattgatcaggaaaaaaacaaccagtaagcaaagtattaatacatgctacaacatagatgaacctcaaaacatcatgtgaattgagagaccacatacttcaatttcatttatatgaaaggtccagaatagacaaatccatagagacagaagttagtttgggggttgcagaggccggaggtgggagaggaatgcagagtgactgctaatgtacacagggtttcttttttggagaagaaaatctaaaattagattgtgatgttggttttacaaaacagtgactatactaaaaaacatttgagttatacacttgagttatatgtaaattaaatcttaataaagctgtttttttaaaaataaatgtttaattctcagaaacaaccctatgaggtagggagtattatcctcctacagatgagaaaaccgaggcccagaaaagaggagaacctgctcaagattacatataaggcatatgtaggattaactttttcattacagagaaatccatggtagtgcttgctaagtaaatgctaaatctattgattgcatggatgccagaactagatggggttagtttagatggattaagggaggaagtggtttaaactgtgttttctaagaagaaagagtagtgattgtataaagaagacaaaagggcatttcaagctggagataattgcttgtgagagttaaacatcaagaaaccagacatctaataggtttgttcaactggagtgaagaatagcctttcatatgacaggtaggtaatcagaagcaagtgaatttagagttatattgttagctgtagtgcgggcttgctgtaattagtagcaggccgacaccttgtaacatctctctggagtgtaaagacatatttctaacagaaatgtgttagtctgcaaagcaaataaggtgcaagcgtaaatgtcctttttccttggactgtctttaccgaatgacatgagcttcacacccttgccttgagctgtcactatcattgcttcactttctattaattagctcggagccttggttctatagtcaacttgaaactgctctggacatatttgctctaatcctcctggacaacctgtgagatgtgccttttcctacacttctgccttgccctggcagccacatgacacactctcgcaaggcaggaacctcagggaggggaggtggcggtgtctgttggcaagtactcagctccctttgaggctgcagatagtaggcattggttaagagtttaaacttgggcaagaactggaagcaaattgggaggacctggaattgtgggtgcttggggaaaaacattacaatgaggactcatatgggtcgtgtggtcatgtttgtttcaagggctttcccttccaaaactggaaaagaaaactgataaaacaaacattgggtggcatttttttctaggcttgtcaatgggtgacttgtttgccgaattaattaaataattaattaattaccttgtttataatcttccttgttttgaaaagatttatggcagtgccttaaatctgtaaatctacccaacaagagaatcttatgaagtaaacaagttaacaggtgaaacatgcctccttttaaatgtttctttataacaaaatgaccatatatcaataacagactgtaacaatgcgtagcaaatgtatttatgtttctcatctattttccactttcaaaaatgtgcttttcccttaaactccaaattgtcttaacaatttcacattttcatttctttcttttcttttttttttttttgaggcggagttttgctcttgttgcccaggctagagagcaatgacgtgatcttggctcactgcaacctccacctcccaggttcaagcgattctcctgtctcagcctcccaagtagctgggattacaggcgcatgccaccacacccggctaatttttttgtgttattagtagcgacgaggtctcgaactccagacctcaggtgatccattcacctctgcctcctaaagtgctgggactacagatgtgagcctggcccaatttcacattttctaggttctgtagaggttcatgtttgtggcatggtaattcttgttttttgcattttttttttcttaacccccctcctggcttttggagcactataaacttagcactggtggggccacatcttgacagcgagacccttacagcccccaaccccgcatcccagtggggcttcatgatctggccctgctgtgctggtggcatggccccctcggggcttaagtgattctgggtcattgacaagaatcttgcctgtgtgaattcaaatcaaaactttggagagcaaagattcagtgttttccttctgcctaacaatctcatggaaagcacagtggtacctagcatttagctcatgtgttcatttagcaggctctaagtcatcttgtcacatgtcatcctcatgtcagctctgtgtggtgttgtcgacccacgagcaaacgttgcaaggtcccctttagggtgacaaggctgattcaggatgtgtctcactgccccaggaaggatgcctctaacatgcggaacatggtgccagtggctgaggggattagttggggaagaagagtgaatagggaaaggaggttgttacatgatccacccctcactggccagagaggaaaaggaaggcatctcattaagagcattagctgtagcctctcatttaaacctcctcactaccccatgaagtaagcattattgcttttgttttacaggtggtgtgagacaaaagtgaaggaatgagactaattaataataagaatccatgccccaccatagctacgatgcagtggagcatggattctaaaccagctctaacatcacatgccctattttcgagcactagtggcttatttctgagctcttctcttcctctttcctgttgatgcttgagttttagttatatcatggcaaattgaaaaattcttcaaaaaacatacagaggaaataaagtggtgggatctgaaacaaaactcttattgattagccattctaatgaagatttgtggctgagatgggagttttgcaatcaccttgggatttcagaaccctgcttttaataattagaactaaagaagggagagtcctatagaagtgtgggtcataaaaccaaggatgtgaatgaggagtggcaagacaggtatcctggagactttatttcagtgagacttctggggcagagttgggactgatgggggacaagtcagctttggaatgatacagaatttttggctgtgacacctgtgtgattttagtgctttgcaccatatcaagagctgagcagagtgtggcaccaatattcaagggactcaaggggcaaatataggtgtcagtgagtgaaagcagatagcgagatttgcaatgcagtgtccaggagtgtccatctttctagacccatttctacttataagatcactgcataccctgtgaaacattatattcatgaagccacagagtttgagccactgtgtttacgctgcaagtggaaggagagtgggcatggagtcagaaagactcaagttcaaatccagcctccataatttatcgtctttaagaccctgggaaagttgacctaagcctctgttttctcagctttaaaacatgaataataatcctgcctcacaggactgctgcacatacggcagtcagcgcagtgccaggcacacacgagtgtcttattagttattattattatcaacaaagagcataggtgatccttcttatcatgattataaaaactgtggcttaccaatgaaagggtccttcataagccaacaaagagacatccctgaaattttcactatagcagaaatgcaaattattactgggtacatttctggcagacacatgagccatttacataatgaaacctctctaatattatttctattaatagcaatacttctgagtatcaatctgaccattttgtatttagaatcattctctctgtgaacagattccttttattgccatgtcgtcttaatatcttctgacaagtatcattatctctttgctgcatattctaatgtttatgattgcatgagttttaaagtgttcatttactacctgagaacctccattttaataatgcattgctttaatgttggtgtttgggaggtaaggttgttgcttattttctcagatgccgattcacagttgagcagatgatgacttgcaggaggctctcttgacctgtcatgctctgatatcatcaatgcattggagtggtcacttctgttagcttttcctccatgaatcccctgttgatcagcccactaagtgactcagcatatgtctgtgcacacctttggaccacattatcatccactcacttaggcccttgaatttttttatgggtatgtgggctatattgctaagtgataaggctggttctgtaaatggacctcgcaacttcagcataacaacggtatggctagtgtcctcctctaggagggactccccttgagggcagatacaggtttttcctgtttgcctcaagagagtcatacaatgcagaagtgcccaagtgaatgttgggtgaatcagtgagtgtaagagggcacccaagggaatgcccacagttggaaggaagttgcctgagaggaggagtcctcagacccattctagctttgtgattctgcccgtacagacatgatttatatgacaggaaaaacatggcaggcccttgggaagcattttcatcttaacctttataatatctaataaatgggcaagatgttaaaaaaaattgccctttccagaagaaggttatacagactctaagaaggcaacattaagaaatttttgaatttttttttttttgagatggagttttgcttttgttgcccaggctggagtgcagtggtgtgatctcggctcactgcaacctctgcctcctgggttcaagcgattctcctgcctcagcctcccaagtagctgggattacaggcgcacaccaccacgtccagctagttttttgtatttttagtagagacagggtttcatcatgttggccaggatggtctcgaactcctgacctcaggggatccacccacttcagcctcccaaagtgcagggattacaggcatgagccaccttgcctggccgaaatatatatatttttaaaaaggttattttcatcccagcactttgaaaggccaaggtgggcagatcacaaagtcaggagttagagaccagccttgcaaacatggtgaaaccccatctctactaaaaaatacaaaaacaattagctgggctggtggcgagtgcctgtaatcccagctacgcgggaggctgaggcaggagaattgcttgaacctgggaggcgaaggttgcagtgagccgagattgcaccactatgctccagcctgggtgacagagcatgactctgcctcagggggaggcggggagaaggttactttcaaccccatgaaaaagtgagcaaaggacatgaacagacacttttcaaaagaagacatatggccaataagaatatgaaaagcagctcaatatcgctggtcattagagcaacgcaaatcaaaagcacaatgagatactatctcataccagtcagaatggctgttgttaaaaagtcaaaaaataaccagttggatgctgatgaggttgcggagaaagggaacacttatacactgttggtgagtgtacaaattagttcagccattgtggaaggcagtgtggcaattctgcaaagagctaaaagcagaactaccattcgacccagcaatcccattactgggtatctacccagaggaatataaatcattctaccataaatttagacacatgcacgcaaatgttcattgcagcactattcacagtagcaaagacacagaatcaacctaaatgcccatcaatgacagattggacaaaaaaaatgtggtacatattaccatggaatactatgcagccataaaaaaggaatgagatcatgtcttttgcaggagtatggaaggagctggaggccattatccttagcaaactatcacaggaacaaaaaactaaatactgcatgttctcacttacaagtgggagctaaatgatgagaactcatggacacaaagaagggaacagcagacactgggtcctacttgagggtagagggtggaggaggaagaggagcagaaaaaacaattattgggtactaggcttagtatctgggtgacgaaaccatctgtacaacaaacccccatggcatgagtttatctatttaataaacctgcacatgtacccctgaacctaaaataaaagcttaagaaataggttattttaaagactatcctaatgcatttgtttgtgtgtgaaatatggttttgctaattagtattctttattgccagtaaaagtaactcactagagggagcttctaagaaacggggattttgatgagggcacgtggatatcccatggattttagggacgggcacggctgggccttggggaaacaaaacaaaacaaacaaataaaccaaaaatcaaaaccaaaaattcacattgaatttggagtttgggtcatattgtatgaacaggactgcttccacctgcattaataggcaaattccagaatactgggtgctgaatgaacagtccagtatggatctgtacggaggctgtaccaaggattggtgtctgtttatttttatttgtgctgctattgaagattttctaatcattagtgctaatattgcaggagaaaataattaatgaaggtgtctactgttctattgtagtaatttctgtttgcagggctcattaacatctttgatcagaatgagcagctcttttctggttggaatagatgaaaattatacaatgtatggagccattcttcaccttgtccttgtttcttcttcatgttgcttcgacttattgctcacaagttgacctcccccttagagctggggtggtccagcagggctgcgttgtgatgtgtattccttttgtgataggagacttgctgagagaggatcctgtttttttgtttgtttgtttgctttgagatggagtcttgctctgccacccaggctggagtgcagtggcatgatctcagctcactgcagcctctgcctcccaggttcaagcgattctcctgcctcagcctcccgagtagctagtatgacaggcgtgagccaccacacccggctaatgtttgtatttttagtagagatgggatttcaccatgttggccaggcaggtctcaaactcctgacctcgtgacccgcccacctcggcctcccaaagtgctgggattacaagtgtgagccaccgcgcctggccgaggaccctgtctttaatgggatgttgggtgatatgtatgaaatggttcaagaagcagatgggaagtgtttgggaggcctactgccagtggctcagtgtagccagggaaaaacagacacacctctgtgccatctctcacatcttagaaggtaacattgagtttgctgcatagaaccatacagttctaggtcacctgaaactcagagctcatgtgatctaaacttctatatttaaaggaggaaagagactcagagaagtaaaaatggcttgaccaagaagtcagactggaaccagaagtggacatatggactcctcattcctgttccagtaccgttgctgccagttcacattgtctttctaaaatagccatttatagggccacagctccatctcaaacaagggcttagtatctgtcagtttgcgaggtctaccataacaaagtaacccagactgagtggcttaaacagcacaaacttattttcttatgattctagagacagtaagtttgaaatgaaagtgtcaggaaagttggttccttctgaagtccttctccttggcttgcagatggccatcttccccctgtgtcctctcgtgggcttccctccaagtctgtgtcccagtctcctgttacaaggacaccagtcatagtggaatagggccctttcatatgaccttattttgttttaattacctctcaaaaggtccaatttccaaatacagttatattctgagaaactggaagttagggcttcaacacatgaattttgagtggttgtggggggaaaaaattcagccagtaacagtatccataagttaacttgattcattagttgattaagtatgattaaaccagctgggcgcagtggctcatgcctgtaatctcagtactttgggaggccgaggtgggtgggcacatcatctgaggtcaggagttcgtgaacagcctggccaacatggtgaaaccccgtctctactaaaaaaacaaaaattagctgggcatggtggtgcgtgcctgtaatcccagctgcttgggaggctgaggcaggagaatcacttgaacctgggaggcagagaggttgcagtgagctaagatcacatgcaccactgcactccagcctgggcaacagaggaagaccctgactcaaaaacaagaaataaagtaaataaataaatattattaaactagattatattggttaccaagtctttacatgaccattttaatagccttttcagatgttaactttgcaataatatgcagccagctaattgaaaattctagtgccataaatgtttttaattgcttactatgtgtcaggcgttgtactaggcactggggaaaactgtaaataaaagagacccagttccttcctttttttcaggttgcagtctatcaggaaaggcagacatttaaaaagggtcttgtgaggactgttatgaaacaggaagtacgagtgccatttctataccttagtacaatcactcgttttaattcacatcttccatggtggcaagtttgcctcagtgtcagccggtcaattgccactcaaggggatcagaacatttatgtatctggaatgcttggtacctagagttctgaagatcactattctcattccaaatatgttttttcattgccagaatgctcactcagtgactggattagttatgtgtactctgcatttttcgaagaggggaaagctgctatttttatcatctagtagcattctgatgactccttgataacatggttactatacggaaccccatctgtttctctgctgggaccacatcttagtcatatttttgtccctaatgtctggcatcgtgcctggcatttagtaggtcttcagtaaatatttgctgaataaatgtatgctgattgaaaaattgcctgctattatcagctctctgtgcatgataaatgccttgcctctccaaagcgattgtaagcttctgagcaggaacaccatggtcacacatggtctgtctaactcagcgccttgtaaataataggaatgccatccctaaatccctagccccctccaggatggcctgtcttccttgcatctgggactgttgaagattcttaatgatggaaaaatcatatacaggttattgcatagacatacattaaaaaatgtagttcgttcagtgtatccctagtgggcctatggccataaattaacttgctcccagggtaggtagtactctcttcttcacttctgctgtaatcacagctgccttcattatagaatcatagagaagtgaattaaggtgaactttgaaagaaggaagagatgcagctcacttgatcgatgtgggagtgggagtgggaagatttttctaggcataaggatggcatcaaagaggcttggctgtttttccattcccagtaatcgttgacagttttttatttaacatttaaaaaagtgtcctccgaaccttaggctgttcaaaaacaagtatttcatggtagagattacgtcaaatgataagcgatgcattctgcgatcagtggcagaaacaaaggttgaagctgcagtttgatgagaatttaaacatacagaagtcaaaaaattcaggagttgaagttaaactgcaagtgtgactcagtcccctcgggcatatggtagtagcattttctgaattgtggcatattcagttaaatttaagcccttgtttttgcagagtcgttgtgtcaaggttgcaatgtgagcagtaactttagactttcacaattttttatattctcacccacagtatgtgctgttatagcatttgtgcactgaaatttggtatagcttataaaaataaaaaaatggtgcaatgctcaatctatggtgcagaatgtatatgattatgaaggaataacccttctgtttgcttgaacccgacctaatactgaaacaaaacaccgccacttttgcttttaagtaaataaataaaccatacattgtggcaaaaggcatacactataaaattgaccgtcttcaccatcaagtgtacattcagtggtattaactgaattcacattgttgtacaactgtcaccaccatccatctccagaactcttttttttttttttttttcttgagacaaagtctcgctctcatcccccaggctggagtgtgatggtgtgatctcagttcactgcaacctctgcttcctgggttcaagtgatcctcctgccccagcctcccaagtagctgggattacaggaacctgccacgacgcctggctaatttctgtatttttagtagagacagggtttcaccatgttggccaggttggtctcaaactcctgacctcaggtgatctgcccacctcggcctcccaaagtgctgggattacaggtgcgagccaccacgcccaacccagaactctttttattttgcaaaattgaaattctacccattaaatagcaactcttcttttcccttctcccccaagcccttggcaactgcttttccatttctatgacaatgtctactctagatacctcatagagggtgaatcatacagtatttgtccttttatgactggcttatttcacttagctgctatattattaataccagctttctggggatataattcacaaactgcagaattgaatggtttttagtctattcacatcggatatgtttttgaagagacagtaaaaccaatccttttttccttagttctcagacacacacatgcttcttatctggcaagtcccgttataaaaatgccatgaactaaatgggaacagaagattgggggaaatatctagattattcttagtttggttcagattaattgagatagccagaatatttttgtaagcatgtttgctttaatttaaatgtcttcattttgcttcctggagccagcaatatgtgattacttattgttgttcttatggggtattgtttgcttgcgtagttgattgtgatgagttggctagaaatttaacagaatggaaatttcttcaagtctggatttgttcaaagaacagtttgaaattgaccaaagcgatagatggaactgacacttgacttatttgagatctggagttcccagtaatgaatattttggtccaagtttgaaaaatggcatttcatgtttatgtactgctgataggaatattcattggtacaaccatttagaaagacagttaggtattatccagttaacaaaaacaaatgtgtataccctgtgactcagcaattttccttctaggtgtttcctagagacttctgtactgtataccacgagacatggaggctctccagcacagctttatttgtgttaataatggtttaaaaaaataaacccaaactacttgaatgtttattaaagtgaaataaacaaattatgatatgatcaaatgacagaacacaatacaacaatgaaagtgaatgatctaaaactatataggagcaatatagatacatttcagtaacctgatatgaagccaaaaaagttacgttgcagaaaaattcaaaatatgaatgattatttttgtaaaatttcaaaagtatgcatcattaaacaagtaaagtggaatttcaccctgagacagttaaaaaaaaaaggctagaagcttagaaagacatggattagaactcgtttttctctgttctgagagtacatgtggaaatgaaagctaccagctatttctgccattttaaatgctcatatgaaatttctaagtaccctgcatagtaagtctttaaaatatcacatacacactactggcaggctaaaaaccaacagaaagatggctgggtaaaaagaaatcatgcatgcagaacactcttacttttaaaaatttacattcctgaaatagaatttttggagagaagcttttcttgaatgatgttagattgaaggatataactaaaaatagaactgcagtctttaataaatgaaaattagtcaagattctaattagtacttcctgtgttcgatactaattttgtcagttcatttctttacttaatgtgggctgtacctattcgcacatcccttgtactctttgcttgtttggttatcgttatgagaccaccaccaaccaccaccaccaccaccatggtcatcatcatcatcaccatctcctagagcacatggttttatgagccctgagctaagctccttaccgtttaatgcaaacatgttcctccctcagggtctttgcattactctaaaataacaccctcatcagtttttatccccttcaccggtttaatttttccttattgcacttacacatacttgtttgtctttctcatttcactaaaatttgagagtgatgttaagtctgtggaagcagagcccatgcttacatctgtcacttgtgtatttccagtgtttaaaactgggcctgtcacacctagaagctcactgatcataatcagtgatcatcaagtgaatgaatgcctgaattagcccaacaactctttgaggtagttattgctgttactattctacagatttttaaaaatggtggcactcagatagattaaactactcgcccacatttacccagcttgtgggtggtggaggctagaattcaaagccagtgtgcctgacaccaaagcctgttgtcttaactactccacttttctgcctatcatctgctgctagttctcagtgactttttatttatttatttttgcatagagcatcttttcttcttttcgggctatcaactcatcatttgtttaattctttgttttttgtttttgagatggaatctcgctctgtctcccaggctggagtgcagtggcacgatcttggctcactgcaacctccattgcctcccgggttcaagcctcagcctccctagtagctgggattacaggtgtgcaccaccacacccagctaatttttgtatttttagtagagacggcattctccatgttggccagggtggtcttgaactcctgacctcaggtgatccacctgccttggcctcccaaagtgttgggattacaggcatgagccgccgggcctggccttgtttaattctctgtatgcacctttttgataaatagttgtgtctccttttagggctatttctgttttgcatatacaaagactttactcatatttcaggttcagccaatttcagcctcttgcagctaacgcccttgccgtgtttagtgctattgtctgggctctgagactgaagcaggtctgtgagagcagccgacaaggtgtcaagaaggaaggatgcaataacccactgagctgcgttatctcctaaatgcatgtgtctttatgccattgctaatggcatctaatgaccttgggctccgaacaggtgctgccttgtaatctgcgctcatttgtctctttctacactgctagatttactgaaataacatgaacagggaaagcaaatgctttcatggatgccaggaatgctttatttatcttttaattttctttcatttgtttcgggatgtagaagcccactttggagttgaaataaaacaactaatgttcagagctgaggttgtcaccctttttagtaggacctcagatctagaaagggccccagagagttctcctttgcttatagaggagagtgtagtcctgtgggaccacatgtggtgctggccagcggagtaggtgggggtcctagaacttatgcagcctgactccctttctggggctccttctgaaacccagtggcatcctccttggcactttgcacacccagctgtaaatacacctgtgccatggagggctaaagccttttgggggggcatatatgggccaactgatgatcaacaacctctgttttcttagatcatctagcttctttatataacgtacctcttcgacttgggttgaccaaactcagatgatctccttaaagatgcatattaaagattgccccaatttcttaggatcctaggatatgagaatcttcatctctctctctctgtctgtgtgtgtatgtgtgtgtgagagagagagagacagagaaatttgtcctaaggaaacaaccagagatgttgaaaaaagatatatatgttcaagaagtccagcacagcatcactaaacgatagcacaatatctggagaattgaatgctagataaatagattatggttggaaattatagttatgttaaatattcacatattctgtgtgtgtgtgtgtgtgtgtgtgtgtgtgtgtgtgtgtttgagagacagagagagagagagagaatatgtatgtgaatatttaacattttgtgtttacagcctttgaagactactgcttttcctctagcatagaaataagatcaaggtttctcctactgtaaaagtttggttgaggggggttattgttttaaaatcaaaataatactaatatataatgagctcttattatggtccagatgctgtactaagtgctttacatacatgtaaaattcaattgccacagcagcccaacagcatagtgttattagccccatttgacagaacaggaagttgaggctcagagaggataagcaacttgcccaaggtggcagatcttaaagtgatagagctatgttttttttttttctttttttttttcccttagagacggagtctcattatgttgctcaggctggcctccaactcctgggctcaagcgatccttgcccctcagcctcctgtgtagctgggactatagtgcatgttgccacgcatggctatagagctatgatttgaatccaagcagtctgactccagggcatgccccagaaattgtttattgtttccctgatcacagaagggatgtatatattcatttagaaaaactggaaatacagaaaagaatgcagagcagatcacgcatacgataaatatgaacatttttagtgtctctagtcatatagattttttaactgggatcatgctgatttactgtttgtgagctagctgcctgatatttaccaggggtctgtatattgtaaacatgctgctgtgtgattttcaagcccacacagtgtgatcttagggcctatcgtaagttttacatcactcatagatactgtaatttccatccataatctatttatctagcatttaattttccagatattgtgctatcgtttagtgatgctgtgctggacttcttgaacatatatatcttttttcaacatctctggttgtttccttaggataaatttccagaactagagctggtggctcaaatagtaaggccctttataaggcttttgatatgtgttattaaattactcttcttgagcacttgccaaccatgacaaagaacgttcatgtgtctgcactctggacaacactaagtactgtaattaaaaaaaaaagaaacaaacaaaaactctgccaatttgataagttaaaaattatatcttgttttaatttgctttttttagtgtagtttcaagtgagggtggatattttccttatgtttctctgttttttacatttcttttttaaattggccattcgtgttcattgcttatttttgtcttagaaagtttttccttttactcacaattacatgtatttattttgtattaaggatattaactctttgtttaatggtattggaaatatttttcccactttgatattttcctttgaattttacttacgttgatttttatttacaaaatcaaaatatctgtgtagtcaagcatattaataattttcaaaaagtgttttgctttttttttttcccacagttgaatcctttttttttttttttttgagacggagtctcgctctgccacccaggctgcagtgcagtggcacgatcttggctcactgcaacctccgcctcccgggttcaagcgattctcctgcttcagcctccagactacaggtgtgtaccaccacgtccagctaatttcttgtatttttagtagagatggggtttcgccatgttggccaggctggtcacgaactcgtgacctcaggtgatccatctgcctcggcctcccaaagtgctgggattacaggcatgagccaccacaccctgcctgaattcttttgttttgtttgttttactttaagttctgggatacacgtgcagaacttgcaggtttgttacataggtatacatgtgccatagtggtttgctgtacctatcaacctgtcatctaggttttaagccctgcatgcattcggtatttgtcttaacactcttcctccccttgtccctccctccgacaggccccggtgtgtgatgttcccctctctgtgtccatgtgttctcaatgttaaactcccacttatgagtgagaacatgcggtgtttggttttctgttcctgggttagtttgctgagaatgatggtttccagcttcatccatgtccctgtaaaggacatgatctcattcttttttatggctgcaatttttttttaatttttttttttgcttttatacctagaaaagccttccattcactagggtcagataactatttacccacaatttattgtagttctttattatctcatagtttatatttatcgtttattttgatgtgcgatcttagacatgaggattcaatgaacttttgtcaaatattagatcagttgttctcacattatgtatttattagtcttttgccccactgagaggagacatcatctttattaagtactaataaaaactaaatgtttttagaaacatgagtatatttcttttttttttttttttgagacagagtttctctctattgcccaggcaggagtgcagcggcgtgatctcggctcactgcaagctccgcctcacgggttcaggccattctcctgcctcagcctcccgagtagctgggactgcaggcgcccgccaccacgcccggctaatttttgtgtgtgtttttagtagagacggggtttcactgtgttagccaggatggtctcgatctcctgacctcgtgatccgcatttctaagccttatattctgttatcttgatatttgttttttttctattttgcttttgattctatgagtttagaagattttaatataattagattctttcatatattttttttcagcatttattagctatttttagtctatttattctttcatgtgtacatagactaatttagtcagattttaaaacatcttttcaaaataaaatttaatttaatagattagatatcaattcagagagaatggaagtctttactgaactcttgtaatttttgatccatgcacaatgtttttcctttagttttttagtaatgcattttctgtttttatagaatctgagcagttcttgttttctttagagattttacagtgttggttataattgtgcacttaatctttattttccttatacagtagtccccccgatcaactgggggcatgttccatacccctggtggattcctgaaactgccagttagtaccaaaccctatatagattgtgttttttcctgtacgtacacaccatgataaaattcaatgtataaattagagattaacaacaataactaataatcaaataaaatacttatataaaaatatactataataaaagttatgtggatgtgatctctctcagtctccaaatatcttcttgtactgtactcgcctattttcagacagcaaattgaccaataaataaaaccatggaaagcaaaaccgtggctatggggagactactgtataagggaaattttcacctgattatcattgcgttttaggaaaactattagtatgtctatgtaagtgtgtgtggaggggtatatgtatatcttctagtaactgaccattatatataattattaatatataatatatataattttatattatacattatataatatattttatataaatatataaaatattttatatatagtatataatatattataaaatatattatatactatatataaaatatattatatatattttttgagacacagtctccttctgtcacccaggctggagtgcagtggcatgatctcagctccctgcagcctctgcctcccaggttcaagtgattcttctgtctcagcctcccaagtatctgggattacaggtgtgtaccaccacacctggctaatttttgtatttttagtagagacagggtttcaccatgttagccaggctggtctcaaacccctgacctcaggtgagccacccaccttggcctcccaaaatgctgggattacagatatgagccactgtgcctggtcaactgaccataatattgatctcagttctagagtctttcagctaattcccttagatattctaagtagacaataacatttccaataatgataattttgtctcctgtattttaatatttttaacttttatttcttctacagcatcctgatggtatgccaaataataatggaagagcagatacaaatacacttgactttattcctgaatttaatttttttttttcttgagacagagtcttgctctgtcacccaggctggagtgcagtggcgcacgatcttggctcattgcaacctctgcctcccaggctcaagtgattctccggccacagactcccaaatatctgggattacaggcatgcaacaccatgcctggctaatttttgtatttttagtagagacggagtttcaccatgttcaccaggctggtctcaaactcctgacctcaagtgatccacccgctcagcctcccaaagtgctggggttacaggcatgagccaccgcatgcagcctgaatttaatcattgactcttgtttttaacttttaatataatattggctactggtttgtggtaggtatcttttactgtggcaaatacatagtattctattctaattttcaaccctctttcccacagaatatttaagagaaaacctttttggccgctttgataatgataatttttgtctattgaatggtgatgctgtgattttcaggatgtatgtatcatggaaactggtagagaaagaaagaactgagatcatgctgaagtatactggggcccaccaagaggtagagctgagtgcaccaattgtcaccaaaatggcaacccgtaaaagagaaccattcttaagaaagagtcatgtaccatcaagcggggatttccagaagcctctgatagtaacagttctcccttccattcctttcctctctactttcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaaatttgtcatttgtatttatattattttattttatttcattttattttatcaagacagggtcttgctctgttgcccaggctggagtgcagtggcacacgatcttggctcattgcaacctctgcctcccaggctcaagtgattctccggcctcagactcccaagtatctgggattacaggcatgcaacaccacgcctggctaatttttgtatttttagtagagacggagtttcaccatgttcgccaggctggtctcaaactcctgacctcaagtgatccacccgcttcagcctcccaaagtgctggggttacaggcatgagccaccgcatgtggcctgaatttaatcattgactcttgtttttaacttttaatataatattggctactggtttgtggtagatatcttttactgtggcaaatacatagtattctattctaattttcaaccctctttcccacagaatatttaagagaaaacctttttggccgctttgataatgataatttttgtctattgaatggtgatgctgtgattttcaggatgtatgtatcatggaaactggtagagaaagaaagaactgagatcatgctgaagtacactggggcccaccaagaggtagagctgagtgcaccaattgtcaccaaaatggcaacccataaaagagaaccattcttaagaaagagtcatgtaccatcaagcggggatttccagaagcctctgatagtaacagttctcccttccattcccttcctctctactctcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaaatttgtcatttctatttatattattttattttatcaagacagggtcttgctctgttgcccaggctggagtgcagtggtgcagtcatagctcactgcaaccttgaacccctgggctcaagcaatcctcccgcctcagcctcccaagtagctgggactgcaggtgcatgccactatgcctggctctttttcttttttaacttttttgtagagatggggtctcactatattgctcaggctggtctcaaactcctgccttgagcaatcctgcctcagcctcccaaagcatggggattacaggtgtgagccaccggacctgaccatttctatattcaaaattttgttaacacagtcaaatattacatattttaaaaatttaaaacattctcaatatttgtgaatttattccacttcttatttttaatttggtttgttctctgaaacttaagattagctagcagtaagtcaatcttatttttgtatatattttaaaacattttgtatatattttaaaatatatgcaaaaataagatagacttactgctagctaattaatagccttttaaaataattttttttttttttttttttttttgagacggagtctcgctctgtcgcccaggccggactgcggactgcagtggcacaatctcggctcactgcaagctccgcttcccgggttcacgccattctcctgcctcagcctcccgagtggctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaaataatttttatctcacatttggatagttttatgtgcttttcctttatattgcttttcttaggtttatttccctttctttttttttttttttaagacagagtctctctctgtcaccaggctggagtgcagtggtgcactctcggctcactgcaacctccaccttacgggttcaagtgattctcctgcctcagcctcccaagtagctgggactacaggtgcgtgccaccatgcccagctaatttttgtatttttagtacagatggagttttgccatgttggccaggatggtctcaatctcttgacctcgtgatctgcctgcccgacctcccaaagtgctgggattacaaaggtgtgagccaccgtgtcccacccccttttctaatttattgagttgatcttttatttttaatttttcttaatgataaaaatactaaagatatttgcctctgactgtaagctgcctacactttgatacataattttctcattatctttattgtctcagtctgtgattccataatttattatcttttatactctacacctatttagaagaattctttttgaatgtacaagttaatttgaattgtttacacttctgtctattaatgagttttgttgcattgtggtcacagaatattgaaaggtagtaaaatttattttatgttccaatacaggattcatttttgttaatgttccatgagcccctgtatagaagatgcatgctctaattaaatctaatcaggcttatcttgtcatcagatctgccatatttatgattttatcctacttctctatatctttattaaattttcatctgctggccgggcgcggtggctcacacctgtaatcccagcactttgggaggctgaggcaggcgcatcatgaggtcaggagatcgagaccgtcctgactaacatggtgaaaccccgtctctactaaaaatacaaaaaattagccgggtgtggtggcgggcacctgtagtcccagctactcgaaaggctgaggcaggagaatggcatgaacccaggaggcggagcttgcagtgagccgagatggagccactgcactccagaatgggcaacagagtgagactctgtctcaaaaaaaaaaaaaaaaaaaaaaaaaaaatttcatctgcttatttttccaaggactgaatgcagtggggtagactttaacattattgcatgtctctcaatctctgttttattttctttatatatttccatgctctactatcttgacacatacaattttgacttaattctttggaatgtatctcttgtcagtaaaaatttcacccctgttgaatgctttagatatgtaatactgattttgtattaacagttgtaaaactgtcacttctaaatgtgcagtttcctggtattcctttgccccaatcttcttgtaacttttatgggtttcttgcagatagtctaagggcattcttaatttatgacaccatctgagattcttttgcttttcaaaacgaattaatacctgtcttcaatgttgatacgcttattctaatttttgtcatctttttattcttttggttttatgattccttgatatttccctcattttccattttgtgtgatatgatttactgtctgtaatactcataccttatatttaatcttctagttgtcttcttaaatttgactaaatatgacctatatttctgtatgagcaaagtgaggaagctggctgaccatacctcctccctgtataagataagattaacacattttattctcctttggaattctccttttcttttttaaagttagatatagacatatagatgttttgatccagtttatgattacttttaaatattatgtaacttttcttaataaggattatctatatctgtgttcctttttataacgatattcagttgtttgttatatgctctccttatatgtgtatatatttttctctagagacagggtcttgctctgtggtgcagcctggagtgcactggtgggatcataactcgctgcagccttgacctcctggctctaaaggatcccccacctcagcctcctaagtagctgggactacaggcacacagccccacgcctggctaactttattttttttttttttttttatagatgacgtctcgatgtgttgtcccgggtggttttaaactcttggcctcaagcaatcctcccacctcggcctcccaaagttctgggattacagggatgagcccctgtgctgggcctgaatccatattgtgaactgttttaaagcacaactaccccttttctttattgtttaaaattaaatttttgattgattagggagcttcttcaaatatattctatgaaatacattgtgtttttgttgctccttgggatccaagaatgccttttttattttttaactctcataccttagtaggaaagttggttagtttggaatttttgtatcagaaccctttgccattagagctgtgtagttgttttatttcttctattgtcagaaatctgattttttttccaccttggtgacctggttacctgtatttcttttcctcctcactgaatgcttatgagttgttttgacctcaaaagttgcaccagaaggtaaataaatagatggaagttttctttaatttattaatttatattaatatttatatcagttttcatttttttcttcttgtatagagtgagtttttggttggttggttggttggttggttggtttactctgtatttcttcagtttagaaaaattttctttcattatttctttaataattgcttctgtggtatttactttgactatgcatcaatcatgctatctctatgttggcttcctactttgtctcctgtatccattagcatctatctgatttgtttatacttttcatcttttttccagtgccttttgggagactttttcaggtttgttcttcacttgctggtttgatgctccaaaggctgtttttccttttcattgcatcgaatgtagttttaaataatactttggaaaatcagtcattgaaaaaaaatcctaatttttttttgtaagttggtgtttctttttgttttcatttacttgtcattcacgcctaagtctgggtctcctccccttctttttcctcctccttcttcaaaggtgcaaatcacatcttgtctgaaacttgtttctatttccagtagtaaatattttttgaaatcgtcttcttcctttatttcttggatgtttcttgttttgttaaccaagtccttataagcccaatgttgccagttttgggtctgctcatcattgaatgatgggagggctagcccgccctggaaattgttctcaaataatctctgtaccattagggaaaggttggactcctttcctcggtcttaagctgaaggctttgttcttaaaaatgtactagaccaggtgtgtttttcagcagctgcacaaatttgtagggagctggagccacagggcaatctctattggggttcttccttgcatggttgctgcttggcaatgggtgaagccatcgtgcaagagacagtggttctcattctgaacttctccctgaccctagcttcactccaagccccctttgtagcagaggatgcatttttctggcatcagagtcctgctatgtagagagacatctcacatcccaccagatggccatgggcatggaggacttatgcttggttctcttcttagtgccttccgaatgtgaatgccctggacaccagacactatctggtttgctagcctgctctcacctccagcgttcagtccattttaggaagatttctaaccagtgctctgtcagaatctcttcttgtttcttctcacagtgctgtgccaccttttcaagaaagagaatcccaacacacatttctgattcagccttttatgtgatgctttctctggtctatctaacaaaatgtcttaatgttaaaaatgctgggtgccctccttttttttcagcactggtgtagacttccccccatctttatatttgtgggaaatggatgttcagattgatgacgtgctctaaagacagagaggggaaatttacaaaacacaaatggagaggaatgtgaattttacaaaagtatttatggagttctctaaataatgaactccctcaggacacttagcacaccaagtaatgtaaaaagttaggcttacacgtagattgtcagacacacagcttttgtatattgtaagctacacctgtatccctgtaatggtccccaggagtatcacgctgcatggtccaattaggtacagaagaactctcaagtagcagccagtcactttgcctgtaataatgtttatgattcagagtggtgcccaattcaccctttgcacttttcccagtggcatttggcagctggggcctggttattcagcagattattgcttctccccagaagcttttgtgatccttgcaggcgctctcctactagggagagaagaatgccaacatattttaaggaaacaaagaataatagtgtcacacgtctttgaataagagtgaaaaaatagttctccccacatccaaacacagtgtagtcaaaattaagaagatagaaatcaagtgtgcatgggcagagggtaggtcataggcttaatgaacccagaagagctttatttattgacttctattttatcccttctcactggtccagctgcaatgattgtcaacaaaggtgacttagaaaaagagagaccttggagagagacagaaagagagagagctggataggcagacagatgtagagcaggtttgtttgcttggcagaacatccaagtcgcagatggttctagaacagaggtaatattgccagggttgcgtggaacagatctggactaaagctgaggcttgcaggtaaagccagtggctcccactccaatgtcattcagcacatagcaatttcagctggagatctgtttatagcataaaacagacactgcagacttttttctccatgagactttaatgtttcatttactaacaagattatatatgggaagtggatgtcataagaagactgtagaatcctattgtctcaccaccgattgaggggcctttgtctatagaccaagcacgtctttttcctcggatgccttgggcatttcagaccatgcccaaaaagatatgttgtgacctgcagacctgtggttgaccatattaggatctgtgatcaatttcttagagattttgggcataaaaaatgagcaaagagccatctttaggaatttggggatatgcttgacccaaggtatttttgttttctactaacacattttgatgtaaagcaagaagtggttttcaacagttgaccatggttgcctagagagatgggtacatattcatgtattttgacctatcagatggaaacaggcttcactcttagaacttccctttggatttcccacccaccccagacactgacattccattttgaagttacacatgaatataacactgacacattgggacatgctttccaagctcaattaccatgcagcgcaatatcaattaagtggatcatgaaacatgtgtctgattgtctcacttgcataatttacattttttgacaacacttaattctcccttatatgtccaggtttcctattttgtgatgcacataattgcagaacttgggagctagaatggaccttggagaggtcccttacgccaaccctttcacttcacagatgtagaaactgaggcttagagagggtataactttcccaaggccacaaaggactagtttacagcagagctgggcttatataacagggctgcctggccggacgcggtggctcatgcctgtaatcccaacactttgggaggccaaggcgggtggatcacctgaggtcaggagttttaaactggtgaaaccccatctctactaaaaatacaaaacattagctgggcatgttggcgcatgcctgtaatcccagctacttgggaggctgaggcaggagaatcgcttgaacccgggaggcagaggttgcagtgagccaagatcgcaccattgtactccagcctgcgcaataagagcaaaagtccgtctcaaaaacaaacaaacaacacacacacacacacacacaactcatggaactgtatactttcccccaaaattcaatttagggccgggcgtgatggctcatgcttgtaatcccagcacttcgggaggctgaggcgggcggatcacgaggtcaggagatcaagaccgtcctggctaacacggcgaaaccccatctctactaaaaatacaaaaaattagccaggtttggtggcaggcgcctgtagtcccagctacttgggaggctgaggcaggagaatcacttgaacccaggagtcggaggtcacagtgagccgagatcgcaccaccggactccagcctgggcgacagagcaagactgtgtctcaaaaaataaaaataaaaaaaaaaacccacaaacaaaaaaaccacaaacaaacgaacaaacaaacaaaacagggctgcccattatcccctgcatggctccagagctattcttaagatcctctgcactttggatcttaagataacattagatttcatagtatccatgaaataacttagacctggtcttggaaatacgtttcaccatccaggtacccatcacatgtgttcgcaggtgaggctttcttagcagcactatgtaaggagacatagtaaagaaatatttattgaatactgaatattgattgagcctatgtcctgtgctaggtgttctaaatatagaaccttatctcatcccataactctttgagttaattgtcattctttttgtttgtttgtttttgagacagggtctcgctctgtctccagagtgacacactgtactccaggctggagtgcagtggcgtgattgtacctcacagcagccttgaactcctgggttcaagcgatccccccacctcatcctcctgagtatctggactatatgtacgtgccaccacacctggctaattttttaaacattatttgtaaagttagggtctcacatgtttcccaggctggtcttgaactcctgggctcaagtgatcctcccatctcagcctcccaaagtgctgggattataggcatgagacactacacctggtcagtatcgttatcttggccattttacggttaagggaatatagacccggcaagtttctatagcttgttccagaccacatagctagtaagctttgaggctcatcctagggtcactgcttgaataacctgcatttttctactgtaccatatgtattctcctgctaatcttcttactgagagagatggtagttcttctaagtatcatatgatccaaaagttgcttaaccaagagctccagcatctgaatccctgagcatacctcttcccccatgcatcatacctgtttcccattctctttgaataattttgaattgtgagcaaatgttcttacaaaataaagaagagagtgtgtccctgcagcattgtctaagtgcagaggatcttaagaatagctctggagccttgcagggctcatgggcagccctgttatataagcccagctctgctgtaaactagtcctcttgtggccttgggaaagtcataccctctttaagcctcggtgtctacatctgtgaagtgaaagcgttggcgtaagggatctcctcaaggtccattctagctcccaagttctgcaattacacgcatcacaaaatagggagcctgaacatataaaggagaatttagtgttgtcataaaatgtaacttatacaagtgagtcaatcggatacgtagttcatgatccactaaattgatactgtgctgcatagtaattgggcattagtggaagcagttcacgtaaaagactataatttgtattacttttacaccattgcaacactttttattgttcctcagtccttgatttgttttctaatgtctctagtgtgtttaacactttctcttgttatgatatgcaccatacatgtgcatgtaatataattcacatatataacatgaaaacatctgattcccacatctaacagtcagacttccgttttcctcttttccaaaatccaggtggtcagctgggtgcagtggcttgagtgtgtatttccagcactttgtgaagccaaagtgggaggattgcttagggcaggagtttgagactagcctgggcaacatagtgaggcctcatctctacattttttttttttaatcagccaggcatggtgatgtgtgcctgtggtcccggctactcagaaggctgaagtgggaggatcacctggttccaggaggctgaggctgcagtgagctctgattgtaccactgcactctagcctgggcaacaaagcaagcctgtctaaaaaaaaaaaaaaaaaagaagagaaacaaaatccagttgtctgaagaggaacaacttcttcctgagacattttctttatttcttttaattttgttttcttttttttagatacagggtctctctccatcacccaggctggagagcagtgatacaattgtggttcattgcagcctcgaactcctgggctcaagcaatggtcctaccacctcagtcagttgagtagctggaactatagatgtgcaccacgtgccacgataatttttgtttttttttttttttttgagacagagttttgctgtgttgcccaggctggtcttgaattcctgggctcaagtggtcttccctccttggccttccaaagtgctgaggttacaggtgtgtgccatgtgcctggcctgttcctctttatctctttgtattgagaggttcttgagaagcatttccatctgctttccatcgttttctcccatgtgcagacttggttaaaagaccttgaggaatcccccctttacgaagccttatccatgagaggacaagataaggagacccttggtttgtggattcagcttccatggtcattcccatcagttcccaccacttctaggagagatagtatcactcgatgctgacctggaaaatcctggtagagacccaggaactcataggactcggtccccacaccctcatgccagtacctgtgtgacggagaggcgcccctttgcatggggtgctgcacaatgccttcgtcaatcttctgccactgtcctcatccccaccccagcctgctcacctcttcccctgtaccccacagccaccaggccagtttcacctggtggaacacttcccccacttcacctgctgtgcctcacctacttcctcctgcctgttctggtgaagcctcccgcgtcttttcttgtggtaatgctcttttctgcctctctaaacttctgccagtgtttttgtatttgatttttgaaattcaactcagacctccaaatgaggcctaagtcaagcctagcttttggcgagctcaccccatttatggtgggggcctgcctggtcacctgctcgtcttaaaacctgcctttccttatggaactgtgttttcaatgaggttctggccgctaagcactcaaggctgtgtacactcaactgttgggctgttggaggtctccccatgagaactttattacagaatggagtatggagcctggaaagggaaggtggcccagtgaggaatggtactgcattctcagtctctgggtgagttgaggcaggggaccagaaggagaggagggaggagtgggaaaggcttaaagcctcttggaaggagaaaagccaggggaaaggagaatggtaactgggaaatgggctaacctcagacctgcctttagcggacgcctggctcgagggcccaagacctcaagctctcagaaactggtaagaatcatgctgtcccaggtcccagtgaggtgactctaggtaggaggcccttagcagaggtggctgggtcaatcccagtcggctgcttttatcttttattttatcggcacttagaaagaaagtatggtgctccttctgagagggctctttaacattgcaatgggccaatcactttatatcattatctcataattattatattacattacattatattatgataattcctgttttgtaaatgagtagccgaagctcagttacatagcctgtccatggtcacagtggaacatgaacccagtttgtgatgtcaaagcatttctatctttatggcaagccttcataggaagcaaaagaagcttgcaaaagtaggagacgttaccttatcctctttccccgttcagaatttgggctgcggccaggctcagtggctcacgcctgtaatctcagcactttgggaggccgaagcgggtggttcatgaggtcaagagatcaagaccattctggccaacacggtgaaaccccatctgtactaaaaatacaaaaattagcagggcatggtggcctgcgcctgtagtcccagctacttgggaggctgaggcaagagacttgcttgaacccaggaggcgaaggttgcagtgagccaagatcatgccactgcactccagcctgggtcacagagcgagactccatctaaaaaaaaaaaaaaagaattttggctgctcactgatgttagaatttaaaagaaagtaaagtgatgcttcaattaaaaaaattaaaagcttaaaaaaattaaaagctttaaagtatggattttttttggtgggcggagcaaaaacagtgactgaagtgtattcatattgaaacactgtggtgtttcactggtgttcaagttgacagggcaggggtgggaaagaattacggagtagaaacccctggggcccaatggggaggcacctagagggcctaaggggaaggatcctacagatgaacttgaccttctttatgattttgcggaagacaactctgcttatctttcctctgggaccagtaaaatagctgttgggggcagatgctttgctgatgcttagtatacaaaagacagcttatatgggggcaatattaattttcttaagtcccttggcatggattctgaaaactttaagatttatgatttgagaaccctgactctaaaatacgtgagaattttctgcttgcaaaatagattacgcttgcacaaaatacgcttgcacaaaatcttctacttgtatttctactctggattgttgaaacaaattgattttttcttttttgagacaaagtctcactctgtcatccaggctggaatgcagtggtgcaatcttggctcactgcaagctccgcctcctgggttcacgccattttcctgcctcagcctcccgagtagctgggactacaggtgcccgccaccacacccaactaatattttttgtattttttagtagagatggggtttcaccgtgttagccaggatggtctcgatctcctgacctcatggtccgcccgcctcggcctcactaagtgctgggattacaggcgtgagccactgcgcacagctgaaataaatagattttaagtggctggctggctctcagattgcatcctgttagaaagtcagaatagaaaatagatgcattttagcagtgttggaagaataaactcaaagtcccctggaaatcctggaccccacccacctcttaccaagtatccagcaggaaccttcttccttactattgttataatacattctagccccagtaatttgttccacgtatctcattagagtgaagatagcaacatacttaaataagaatttcatttttcagttttagcttttgatgtaggctaaatgctctgtgtcacataacttagactacctacatgcctcatacactgataccctattttgaaattacacatgaatttaacactgccacgttgggacgtgctttctaaagttacctatgaaataacttagatccggtcttggaaacaccttttaccagctaggtacccatcacatagcttagtaggtgatggtggggtccttcgtttttttgactacccgtataatttcaggagcaagcctaattgttatgcctcctttgttattacctcccctagcctagataacatgccttccaaattgtattgagagtacacaggaagacaactgcagcaggcaaccagctctaacaactgcgtcattttctaagaatcaaaggaattacttgagtttctagttctggctttggcttgccagacatataccttaccccagcgaggtaaatgattcaatcatttgggaatgattgaagttgctgcctaattcataacttataggtgattaaacttgtaaagtattttgaggctgtttctttcattcatttattccaaacaaacatttgttgttgaatgggtagtgactttgattttaaaacactatacagacataaaatagtggcagcttgtagatagcaattttttaatttgctgtccttaaggaatttcgttaccaaatcctcacgaatcttgaaccttagaagaataatcctttcctttgttggagttttaaatttagaataatcagacaatagtgaagcattctgttcaaagcattccttttaggctacccatttattatacgctgctcttaagaggagatgaatttgattagcattgaacattcagtcagtgtttttgcatagctaatatcacggagaaattttcaaaaaaagttatgcctgctatttaacattattatacagtcaacttttaattatctgtattaatggaatgtaatcagtgatgtgttgctccaaaatcatttcctttggctttgagaagcaccggatgatgcttttattggtttgtggttttgcttagatagtattaaaattgtgccacatgtgtgcacatagctcatcttagggaggaagtagcccaaaagtatactgggggctagggaaaggtcaactggaatttttaaacctaccacagatacatatacaatggatgaccccaagattattcatcttaattattaaataaaaaacaatggccaagaattatataatggcagctgtgtaagaaaaaagacgcaatgaaccacatgtgagatttccatgtaggacacacattgtttcccacctttcccttttgaaatttcctgaaagtgaaacactctcataacactacagcagtgaacactgttagatttagtgatcctccaaatgcattttgctggtgctccaaataggcctcttgggggaacagaaggaacagaagggctgatgtcttgacatgttaatgtttctagataatgtcacctttaggtgtgatagctgttactgtttattattttttaaataaccctcttgttcccattcattcaagttaagctttttttttttttttgagacggagtttcactctgtcaccaggctggagtgcagtggcgcgatctctgctcactgcaacctctgactccctggttcaagctgttctcctgtctcaccctcctgagtagctgggattacaggcacgtgccaccatacccagctaatttttgtatttttagtagagacaaggtttcagcatgttggccaggatggtttcgatcttctgacctcatgatccgctcgcctcagcctcccaaaatgctgggattacaggtgtgagccaccatgcccggcctaagcttgttttttttttaatgaataacaatgatagaaggaaatctttggagggtttatcttcttagtagcggcctttcaaatttcaaaagtcttctcagtgcacaaatctgtttttgcatgaggctgctatagggccagcacttttagtcctctgtggcctgttcacctgagtgagtggtgacatttcttggttcataccttggaaggcaatgatggctggccctttagagtgaggtgaaggaagactgatccctgggtgtggaggtactgatgcataggaaaagaaaacatctttggtgacaccattgggtgtcagatcagtttttggcaagttggcaggaaagtctccaaatcagtggggtctggctgggcaccagcaagttggaagctgcattagttccttctgctggcatgtccccctgtcatctggccatagcctcatctgctcctactaccttgcaggtgcccttggggtaaagctgtccagatgcacatgaacccctcctcttttcagctggacaccaagccaggaaaaggagaggtgtgactttttgacggaggccagtttctatgtcagcagccttgccagtgaacactgcaaaatggtgtcagcctgcagcctttttgtgcactggagcagagctcccctcaccacatttgtgaaacaggttctgtcatggggcccaggtgtccttttctcctgccacccccactccagcttgctggccgccttatcattccacaccaggaagccagcatccttgagttgtccttacttcttatgacctgctgtgtagaaagagaggggaaaaccagtgtccgagtggctgctgtgggtgtggtctgggccgcgtagttttatatacgtaacaaccttctgagacaagcgttagtgactccttttacagcggatgaacttgagggtcaagccagtaaataatttcctcaaagtgacagagctggaaagtggtaaagttaggatcaatactcggctttgattttaaaatatgcatatgcatatattttggagatctggatataccacttccaaagtagcatattatactgaaatttcaaaagagaaaacatctttaaacaaaaggaaataactcttaattatggagtttcaggtatcaatgtgttgctggagggctgtgatcttaaaagcatgtcacattggcaacccgttccggcaggttgtgacaagctatgtagcatgcatgaaagcatcattcattttttaaaaaatgtcttcaccatttatttctttaattttttgttttaactttttatatttataggcaataattatgtatatttatggggtacagtgtgatgtttttataatgcatacattataacaagattcaatcaagctagttaatatattcatcacctcaccagtttatcattttgtgtgtgtgtaagaacattaaaaatctgtgttagcaatttacttcattcttaatggcagactcagcttctttttttttttaaatcctagactgttggcttctccttccagcagtgttgtaggactcagctgcctttctttgctgtccctggccagagatgtgtgcactcctggtctcctaataaaactttagcctatgctgggagccatggatttggcagcactgcctttagcatttaggaatatgtttctccttacatcaagaatagttttaggccaggcatggtggctcacgcctgcaaatcccagcaccttgggaggccgaggcgggtggatcacctgaggtcgggagtttgagatcagcctaaccaacatggtgaaaccccgtctcgactgaaaatacaaaaaaatagccaagtgtggtggcatgtgcctggaagcccagctactggggaggcagaggcaggagaatcgctagaatctgagaggtagaggctgcagtgagccaagattgcgccactgcactccagcctgggtgacagagcaagactctgtctcaaaaaaaaaaaaaaaatagatttatgctgcttgttgaggaccagcagtattctcaaccatgtgaggcattcttcgaacatgtgaagcagcattttcctggatgggcatttctgccataattgtgggcagaaaaaggtgtggtccacatatgcccaacagggccaaggggcaagggtgagcatgtacctatgtcttataccccggagattcttgcggctgacgaggttcccttacaaagcccaaaggaattctcctccttccaccggaggtgtttataacctctaatttgctcaccatgcttctagtggaaggagtaggagctcaatcccctgggaggctgcggcagagccagagcaggctggtgacccagagcagtggcactcccctctgagtgcatgatgcagatggagcaggagggggatgcaggtgggacaccctgcgccctgcaggtgagtgcacagccagcgagacacccaatcagggagcaggaaggctgtccctgtggcagcaggtaaaagagagagtcgctgagatgaaattcgtgggtgtgtgcttcagcttgtttgaacagctcctgtgcaagatcttatagtaaatgctgagcttctttgtgctctgtgcctgtcggtggaaggcatagcccttgatgaagatttctccttctacccatcttgcctttggaaagggctcccctttgacaaatgctgctgtagtatttgatgcagcctccatgaggtgctttgggtgggaagtggattctgacctcatttcccagaggaatttgaagtggaggggaaggactaattggtccctcattaaggacttacaatgaagtacagtatttctcctgaaaggataatctaagtcactggataaaatgcccaacacacttttaacgtgacataggaatccaaagtcatttttaaatcaaagatttttgtagttgtggagaatggctgtgttttaatgggatctttacatatcagcattacaaagggctccttcaaatgtgatgattttaatgtttttgctggggtttcacctgaggttccaaatacatatttccctatcatatttgcaggcatccagcacccgattttagatatgcaaatcagctcactttgtttaccaggctttggataggggagaaaaggaggtctgaggctgggcacggtggccacacctgttatccagcactttgggaggccaagatgagaggattgcttgaggccaggagttcaagatcagctttggcaagatagagacctcgtctttacaaaaaataagtaaaaattagccaagcatggaggcgtgcatctgtagtcccagctcctctggaggctgaggcaggaggattgcttgagcccaggagttagaggctgcagtgagctatgatcgtgccattgcacagcctgggtgacagagctagattcagtctctgaaaaataaaaaaacaaaataacggggctgcaaaagcttccttgacgaagaaggaaagtctctcgctcctgtttaacactgcctggctgggttccagctcactagcttaaaacgagaaggcaccaccactgtgattaaaataaggccctacttaattaaaacagtgtgagaatttaataagaggcataagacttcactgatagtcaccaaaaaatctcaaaaaggtgacttaacaggcattaatagcatatgttgcttgtttactctctgtcaacattccgttttccagagacatccttcgtacaggtgaaagtctctcattcctccctctcccctcactgcctgcctttcagccatttccttgctttttgtagttaaccagtaagaaagagaccataatggagaaagaacacactgactgtgtttcacagactgttgccctcatctccacttgtgttaaagaaggtaaattagttcccctccagattaacttcagcgtcagctgtggtgctttcctgacacttcttaacatttgaacagtaccacattctgtccgttttatcgttgtctcttctcataccctgtatttgccaattctgtactcatgcccagacagatctataggtatatgtaggaggatgatgaagaacgggccgattcgtagctcaccctttgagccaggaccaaaggtttgggagtcttaggctctgaccttattcttttggagaggaaagaatcattttcctttaagcctaagtctggcaaaatctaattacaaagtttttcgattttgctattttaaaataaaagctaagccttccccccatctaatcagccctctcttcctctgcttctaatagtgaaggaaataaagaagtctctcaatttcacaagcttgaggtacttatatttgtacatgatttcctgttctaagtgggtggttttggcccctggcacttcatgtacgctagggcatttttggacacttttggtatccaccttgcttaagaattgaatgactaggaaagaaggtcatggggagtcttcaaattattaaccctcagtccaatctaagtcattagttaatgccatgtttgaaggtggtaaagtaaccgtcatcttacgaagtaactctcgtttgttatgcttagtgctgaacaaagtataaactcaccaatgtgagagacagggacaggatgcttatttctttatggatatttagaatttgagcctgtaggctgggcacggtggctcacgcctgtaatcccagcactttgggaggccgaggcaggcggatcacgaggtcaagagatccagaccgtcctggccaacatagtgaaacctcgtctcttctaaaaatacaaaaattaggtgggggtggtggtgcgcacctgtagtcccagatactcgggaggctgaggcaggagaatcacttgaacccaggaggtggaggctgtagtgagccgagatcgtgccactgcactccagcctggcgacagaatgagactccgtctcaaaaaataaataaataaaaaaaaaaaaaggaaaaaaaggaatttgagcctgtaacaccaacttcagcacaaatagatctctttcttgattctgaaatgatttatcagttttaaaaaatggtggggtgcactgctggtgggagtgtaggttgatatagtcatttgggaaagcaatttggcactattgtttaacagtgaatattcatagacccattcctaggcaataacccagggaaacttatgctgatgggtattgttcctaatggacacagcattgtttctaatagaaaaaaaaacgaagctgaaaaaattttaaaggtcgtcaacagacatatatatatatattagtctaatatatgacaattagactaatatatatattaattagactaatatatattagcttctatccctgtagactaatatatattagtctaatatataataattgaactaatatgtataatttgactaatatgtatattagcttctatctctatagacatatattagtctaatatataataattagactaatatgtataataattggactaatatatgtattagcttctatctctccagactaatatatatatatattagtctattgagaacctttatatatatatatatatatatatgcacacacacatatacacgtacatacatacatatatataattttttgcttcacagaatggaatattatacagcagtgaatatgaaggaactatagtagctacctgtaacaacatggctaaatcttagaaacaatattgtgtgaaaaaaactagtcacaaaagactatatacagtatgatagtattataaagtttaaaatcaagcacaattaaactatgtattttagagagtgatagatagaaaatttaagatagtggttacccctggagagaaggcaggaggatggcttagggaaatagcaaataggtagatggatcaaaatacccctaaatgtctagttctcaaatagggtggtcggtgtatgcctgttcattttattcttatgcttcacaggttacgtacatgttagtgcattcttttgtgggttacaaacattgcatgatagaaatatttttaaagtgatagcatgtcagaattatggcttgttttttccatctctatttcctaacattctctttccatagtccccagggagggggcttgagatcacacaggagtaattagaaggtctgcttctgacagtgtcgctccttgagtggtggaggttttagggggaggctgacagtaactactgagtggaattgagaggtgaagccagctggacttcctgggtcgagtggggacttggagaacttttctgtcttccaagggtattataaaatgcagcagtcagtgctctgtagctagcaagaggtttgtaaaatgcaccaatcagtgctctgtaaaaatgcaccagtcagtgctctgtagctagcaagagatttgtaaaatgcaccaatcagtactttgtaaaatggaccaatcagcagggttctaaaagtaaccaatcatggggaggattgagaaaagggcgttctgataggacagaaacaggacatggacgggaaaaataatggaataaaagctgccccccccaaccccccacccccacccgcaccagccaccagtgcaacctgctcagattcttttccagctgtggaagctttgttctttcactctttatgataaatcttgctgctgttcagtcttttgggtctgtgccatctttaagagctgtaacagtcaccgcaaaggttagcggctccattcttgaagtcagcgagaccacgaacccaccagaaggaaccaactccagacacagaatcagctaggagacgtgggtgctttctgtatagtgcttcctaccaaaagcctagaaaatcttggggcgtggagaaaagaaaatccatcaagtaaaggcttgatcacctcttggaaaacccatattcattgtcccaacagtgactaatacgtctaactgtgggcctgggtaggatattatgagaaacctgttcttttggtgcccacctttcttttctgagcaacacgtggtcttctgagtgaggcaggagtccggcatatgcgtgatgatgtaatatgttaggcagccaggccctcaccttttcaaaggttcgatcttgaaaaatcaaaggtggatatgtgagaaataagcccatataggaataagaatgacaatggaagtggaaaatgtaagttgggactgatgttctgctgctttgagtactgaaattctctgctgctcggattcatcatcactgaagtgctggccagtactgggaggggggcagagctctcccgggagtcgtcgcttattctgaaacagctgagcagaataatgagtgacaggctggtggtggggaggttgagtcttactccggatttccattaaatgagtgcatggaatcaatagctaactgaacatttgtctttagaacacccaggggcccctggggaatttggtattttcagtctaattctcagacaggaaaatgcgcagcatgactattttttaaaatagtttcaacatcttttatgtaatgctgatgcatctggaagtgaaaacgctaagagtttcatttcactaaaaaatggattttttttggctttaacctttaagttgaaatcacaattagtggccttttcaccatagtcataagagtatcaaagtgtgtgtattcacccacacatcaaaccagtgtttactgagagtatattctgtgcaaagaattgtgcagtttgttatgaaaaatacagagacctcgctggggcccctaaggagctcatagtctagaaagggagacagatcattacacggcagggaaaatacaatatgtatgggagcatgtcacaaaggaagtgacatcgagctgaatcttaaaggaagagcaatgcttgaatgaatgaggacatccctgattgaaggaccagcataatgaacaaagaattttgccttatattactaagattccatcagatgttatgacgcaaacataagcatcatggtaatgaaattaatagtaaatttaaataaaaatgatcaaattaagacttttttggttttgtctattctaccttctcattttaattatgttgcaaagaaccatatacttagggtaaactggtcaatagctgtggccatggaatagaattataattcaatttaaaaggagtttaatagtctcatggtaaatgaataggttacagctgggcactgtggctcacacctgtagtcccagttctttgggaggcctaggtgggaagattgctggagaccagtagtttgagtccagcctgggcgacatagcaagaccctgtctctactaaaaaattaaaaaaatagttgggcgcagtggctcacgcctgtaatcacagcactttgggagaccacatgctggtcgagaccatcctggccaacatggagaaaccccatctctactaaaaatacaaaattagctggacgtggtggtgcatgcctgtaatcccagctactcaggaggctgaggcaggataattgcttgaacctggaaggcggaggttatggtgagtggagattgcgccattgcactccagcctgggcaacaggagtgaaactatgtttcaaaaaaaaaaaaaaattaaaaaattagccaggcatggtggcgtgtgcctgtagtcccagctacccaggaggctgaggtgagaggaccacctgagcccgagaggttgaggctgaagtgagctgtcatcacaccactgcactccaacctgggaaacagagtgagaacttgtctcaaagaaaaaaaaaaaagaatgttatgaatttagtatttttatacttcccctacaactctagtatctctgaggaaaagcctcaatcagaaaaatgatttgctttggggttttatcttttatcagtgataaatgtgaattgagaatagaaatctcaaaatgcaataatgatagtactttatatttcagtaggacttaatatataaaactctaatatgcattatttaaatttggccaatatgcaagagaaaagcaacatagggcagaattatgagtttgcttcgtaaaataactattaccagttcattctgttcaactatgtactggtagcatttgtaaacaattcattcttattttttttccaaagtgcattgcaaaatagtcttgcctgtattttcctgtttgcagtctatttcattaaatttctgcaattctaaattagaatagcatctaatagaccacatatgaaatgtgcttgctattaattcagacattttatggcatattcattagtcaaatccttagtatttatttatgaagtcacattactctgtccagtaattaacagaagtggatgaatatgcatctctaattttttttttagcaaaagaaatagcttacagtaagtatttataattacgtcagctcaatgtttacagcacttgaatggcgatatgtgtagtttctgtcatttagacttcatagataatttttgtacagaaatgctttgttgttgatgctttgcttccttcacacatatatcacagattaccgaaacaatcattagtccttcagttgcaacggataagactcttctttatccttaattttctgagctcctttctaggcattttatgttcttacacagatgctaatgctaattaatgctttaatatgaaagatactggcaaataaaactgttacattttacccataagttgtaaattcagcttagttgccctaacaatactgatagtgataatggctgtacaattaatatttatggagtgcttccagtatactgagctctgtgctaaacattttacttatgtagcttagttaactctcgtaacaaccctgtgaggtaggtgttattagcccgtttcacagatgaatttgtaatcattatgccttaccacatttaataataacattctctattaatcgtatatttcagatgcccagctctggaactttgcagtatgaaacgtgtgtgtatgtgtgtgatgtatatataatatataagtatgtatatataatatataaatgtagattatataatatatatgtgtgcgtgtatatacacacatttcttttttttgttgttgttaatttatgtgccacgctgctgtacgaaactctggggtactatgatgaggggatacctctttcttgcctttaagggacttaggttgtggtgggagagatggacttggttaaggaacaagtacaggaaaatatgataattgctttaatagggataggtacaggggttgtagaaaaatgagagaaaagggcccccacttcccagaaggtgtcagggagtttttcacagagaagcgtccccagccctgagacttgaagactgagtgagtttgaaaagatgatgtgtggggggaacagaagagagaagggtgtggagatgagggaaacaagatggggtcagggagctacagggagggacttggaggtgctgagggtcaagtgcagcaggaggagagacccggctggctggggtcagagctcaaggagccttgcatgttacccaaaggaatgtagatgtcatactctgtgtgctggaaaacgatttacagatgaatccaatcaacactaattaaatcagtatgattaagggatgaccttcctttcttcctaccttcctccctcccttcctccttccctccttctttggctcatttattcactcagaagattttattgagtgcccataatgtgcaaagctttccattgaatcccaaagatgaaaggaggggtgagagtggacacagttctccctttctggagtttattgattcgtgggggaaaacaagcattaatcaatgaatcaaccaaaaaatgtaaaagttacaaaatgactactataaccagggagggtcattctatacaagtgtgtcctaggaggtggtgacctggctgaggaagtctcccttgagaagaggactgagctgagagctgaaggagaaaagaatacaaggtcatttgatagaaggggtgggtgatttgaggagaagtcttagcaaggaggaagtcatgtgcaaaggctttaaggcctgggaaagcaaggtccttttaaggaattgaaagtaagccagccatgctgtagtgcaagttggaagagaatgcaggttttgggggccatgtttagaaatggaaagccactgcaatgccttaggcaggagccaaggaaggtagtagggtggcagggtggacgcggggagacgtgttagggggccagggaaagagtccagatgagccagggtggtgccggagaggagcggagggagttgaggagtatggctgcatggttgaatatggggcataatttgggagaggaagacgtcagagtgatgttgatgccatcactgagctaggaaacgtaggtgaggcagaatctattctgcttagatttccagaaaacattaggggatagatgaggatgacatcacaatggaatttaagctatttaagctcaaggttggccttgaaaaatgagtaggaattttctttttttttttttttagacagagttccgctgttgatgcccaggctgtagtgcaatggcacgatctcagcttactgcaacctctgcctcccaggttcaagcgattctcctgcctcagcctcccgggtcactgggattacaggcgcccaccaccatgcctggctagtttttttttttagtatagatggggtttcaccatgttggccaggctggtctcgaactcctgacctcaggtgatcctcccgccttggccccccaaagtgctggatttacaggcatgagccactgtgtccagctgaaaaatgagtaggaattttctaaatggcaaggagaggcaaagcatgttaatcaaagggagtgtcatatgcaaaggcagaggcataacaaaaatagtgcaaataaatgcctacacatatacaaaaggagagttattgtgggacccatacataattttgttgatttcttgatatgctcatatccattttgtgttgcagtgattctaagatctgtattagtatgtagactttgtgaacaggtaaacatgtttaagaattttttaagacatggctgtattagatatcgaaattcctctcttcattttcatatctttactttggaattcatatatgccttttgatgttatcatctgacttgtttctaatgaaatttagccgcttaggcaggacgtggattttaggtttctgcttagtgttttggcatctggatttgggattacttagcatttttaatttactaaaataaccaccaacttacactcagttgaaatatgaacatgtcggtttcacttgagcttgggaattaaaatcaaagtacagtcaaatccaaaacaaataatagtaattttaagactaggtgacataaccctctgggaaaaatgaggtgatagtgatttgatactttttttttttttgagacagagtcttgctttgtcaccaggctggagtgcagtggcatgatctcagctcactgcaaactctgccttccggttcaagtgattctcctgcctcagcttcctgagtagctgggattacgggcacgcaccaccatgcgtggctaatttttgtatttttagtagagatggggttacaccatgttggccaggatggtctcgatctcctgacctcatgatccgcccacctcagcctcccaaagtgctgggattacaggcatgagccaccatgccccagccccgatatgttttaatactaactacagaagtgttggtagaaagatcagccttgaagagatggtatagtactagaatcctaagcatgacctctgtgaactgttggcttaagtactggctttaacatccgttggctgtatttactgtcagttttcttgtcaataatgcagaggtaaacatgattcctggccacctcacagactgcagtggagtggggcaatgtgtgtaaagcccttagcacatggcccagaacatagtaaatgtttaatcaatgttcgtgatgaccttggccatcactgacatcatgtcttaactgagttattaacaaagaggcatgtgtagtttcaaaagtgaaagtgaggccggaatggtaaatacatgcactgaatttgcataattttgtggctagaaggagtcttagagaaagagagcatcaaattcagcaatgtttctgacattttctatgaagaactgactgcttgttatttcttagaaatcttagaatcattgagcagggaaggaggggcaggaacgggattattttgatagtggtgtcctcaaggggaggagatggggtgggaagcaacccctggccagaacccactcatccctggggatagggacctgctgtgtctctgcctgctgagtttttgacattctgatttaaaaaccttgtgtgtgtgtgtgtgtgtgtgtgcgcatgcttgcgtgtgtgcatgtgtgtgtgagagattatgcaatatgatgtttcccgtttctgtgacttcagcgaatgtgaatgaagaccacagaagcagcctaactcagtgagaatattgtttttataattacaggtctaggcgttttacactgagattctccactgccaccctttctactcaagcaaaatcttcgtgaaaagatctgctgcaaggaactgatagcttatggttctccattgtgatgaaagcacatggtacaggtaaacatctccaaaagctttaaaggaaaataattatcattgagttgtaaagtccccaagatagtggtgggggtgtatacatatctggtcacacaaacatacacacacaacatacacatgtctattcatgtagactccattttttcctactgtctcttttataaaaatggaacccttgcttttttatgggaaaggaaataacttctacttattttgaggtcactagttaggatagatgacaaggcattgctgataattctgaaggcatttataaatttatagatttataaattcacttagagagacaaacatcaaatggtagtagagattgtagaagtagtagagattattaagagtattgttcctcttaacaatataattctgaacatctttcatagcaacagatatttttctaccgtatagttattaatgattagtataccattgagtaaacattctaaaatttatttaatttatatcccttctaactggacagttagccgtttctaatttttttgcctttttattttcttgagatagggtctcactctgtcacccaggctggagtgcagtggcatgattttggctcattgcagcttccacctccaaggctcaagtgatcctcccacctcagcctcccaagtattaatagctgggactacaggtgcacatcaccatgcctggctaacttttgtattttttttttttatatagtgatgaggttttgccatgttgcccaggctggtctcaaactcgtgacctcaagcagtcttcccacctcagcctcccaaagtgttgggattacaggcgtgatccaccacacccagacattttattgctttcatgatgccaaaaatattcttatagctctgtattagttcccattacaaattatttccttaggctaatttcttagcagcatactggtaaatgtaagagttttcaagttttacggcttttggtaacttgttgccaaattactttcagtaaagtcataccagtttgtatttccagaggcagtttatgagagcgtctacttaatacagttttccaatgctgagaattttgaaaacaaaaagagttttttgctgactgattatgcaaaatggtgtttccatgtattttgggttttgggggtggggggggtcatttgtaagtcaagtaaattgtactgttttgtagaaccttcctccattagacagcagcatccttgaaacttaccagatttcgacatttcagaaataatattaaatccagaaggagtagaagggtcctagggaattttaagttcttcctttctggccaagtatttttagacaactatgaaatcactagatacaatcatttttcagtggaaagcataatttttcatttcttaaaaagagcaaaaaggtatttaataaaaaaattttattagatatgtatctgaagttatactgctcattagtttaaaaatatgtatgtgcctatatatgtatgtgtgtgtgtatatatatatatgtgtatatgtgtgtgtgtgtgtgtgtgtgtgtgtgtatatatatatatatatatatgtccaatatcgggaacatgattaaatataactatgttagtgccatatgatggaaaagctgtagataagattgcaagcttcaggctgcctgggctcaaattccagctctgctgttttcttgaagtgtgacattgggcaagttactttgcatgtaaaattcggataataatagtacccttctcccttgggtgttgctgcaaataatatatatgaaatgtttaaaatcgttaaaactcctatttcaggagtatttaatcatttgagaaaatgatcaatatagaagtaaacaaatgtagggtattggcatgaaccatagtataatcctaatcttccaaaattactttgcctctctttcctccctcttttcatcctcctctagtatctacaaaaagggtttagcatacttctgaatggatttaatttgtattagtggagtaatcccagtcctggagagacttcctgattcaagttttcaagtcagagacccatttttcacagagctttgaaaccatggctgtctggatcacctggctgggggcacccttggagcagccgttgggtgagagcagagcttccttcccagccagggctgcctagctcctgtggtacagcaagtgccttgggcacagagtccctcaccgtctggcaccatatgtgagctgccctagttggctcatctcttcccgtcattactaaataagcttcatttcactaaataaatgaaagagaaggtagatgaagagacccccccgccacacccagctcttaggaaacgcatgctttatcctacagatgcatgaaggggaaggctgtaggtttgtgaatctcttgaccctttggctccatcgtaacgttgaaaagtgaaaggaaaagtggtcaaagaatcatttggcatgaaggagacaaacacagaacgacgtgtacggcttcagcctctgcctttcactggttaccctgctatgagcttgtgtatgtagacgctgcattcgttttggccctaatttctggtctaatttgaacagctctgtatttctcagcagaagaggaatatctgaattcctaattaagacatgttagcttaagaatacctccttaatgtgtcataaatcattcccctgtgactatgaggatgaataagaaaacaaaacttggatttatacacacatgtatattatttcaacaaaattaataagttcatagagggagagaggacaacaaatgtgttagcaaatataggtcaggaaaagagttcataatgttctgccagattctgatgaggcacctcatgagtgtaggtagaaggcctcaagtaacggtagtgggaatggtaataacactaccatatggaacatttggtatttgaatagcacttagcttcctcccaaactacaaaatcaataaagactcagagaggaagaaaggattctcttgctgtggatcactggctggtgtgcagaaatgcagacgtgttggttgtcaagggcttaccagaataaatttctctagggagacaggagagtgggaaatacttaaccatattaattgtgctgtgacctcagatctgtggtcagcagtttttggttgtttccatatactgcacatggttgcccacaccatttttgcattcatgtacaagacctatctgcaagaccaggcagaatcattgttgaaatcttagttcgcaaagtcccatggggactttggggtgtcttaggattttgccagcacaaagttaaagcacaacttttgaattgtgagaaactgagacaaggtctttaattttaatcccattcagtcattcctcactcatttattaatttagcaaaggcctttttaggggcagctatgtcccagtatagggctgggcattgaagataatggaggaaaacaagattgacaaaagactggccctaatggagtttacagttctcagggagatacagtcaacaccatcataactggtttgggggaacaggggagatgaactggaccattctaaaaggaggcaagaggtgcatctgaaattggaaactggagaaaccaggggagacagacctgttgatctggaaggcatagaacagaaagaaccagagaatagtcagggactgacaatgaggttgtgattgttgacagccggaccaggccaggaaatgaagaaggtaaggagagaagcgtactgtctaacacccctcgaatgcacagttgctagggccagtaaagatcatcgggctactcatctctcaatttaggtaatgtaaatgatgcatcttattgacaatccatatccttaagaaattgtgaaatgagtcttttactttttataactctacaaacatgttagaaagatggatgtcaccgtgtctttatcacagtatggtgatttttcttaaccacccaaaggaagaatcgaggtgcaccagaacacgtgtaccttgttctcttattaaccatatcctttttcttactttacccactataattcacctcagagagtgagattaattatataattaatcctaccttttgtgcacatgcataattaactttatttagttcactttaaacagattttaggttccagatctaaataatagcccctccatttgtcacatcttgacctctttactatttggtacccttccactcagcattgtttgtgggattgtggttcttcttaccttcctccctccattcctgggtgcttttagtggtctcttaaataacaggctctgctcagagatttcttttatctccttaggccttgacctgcatttggtaaaggctgcatttttagcttcggatttactgtctttgacgaacctttttctctattgtatccctccctggtcagctgctctcttcgggccctcaaacatccaccacgtactctacccagatgttttcttctttctttaacatgtccagttgagttgcccatatcatcccctactccccatccacacacccacccagcacacacacacacacacacacgcgcgcacacacacacacacacacacacacacacagtgcattctcgaacatggggtcttttccccttcaggcaccgtatgtaacccaccccgcccctcagctcttaggaaatgtttcctttatcctacagaaacacaaaaagaaaaactgtagggttgtgagtccctctcaacccttcgactacatctatatcataaggttgaaaatgaaatgaaaaaggttgaaatgtacatttctaaggttaagaaaatcctactgatattaagtatttaaaacacagacttccccaaaatttatctttcagcataaatatgcccttcccttttctcccacccttccttcaatctgtagatagcctccataattcatagccagtttgggtaaaggcattattttgagacatttaatgatttttttaggaaaagcgaaaaaatgtagggtcaaagattcaagagtatattgtgttttatatgtaggcgtagcttttaaactattttggatactttaaagttttaaaataacttaccaggcttctttatgaagcattttattctttgaaagttttataaataatatgatttctggtgtcagtatggaaacattcacatagttgtaataactctcatgaaataaggtagactattccatcatctgtgtttactcttaaaacacattagaaaatggttgatatcaaagcttacaattttgtctttcttattgctaccctaaagcagactgctgcacagaccttcccctgctacactaatgctgctttcaatgttggcaaaccatactactcaaagtgcgggcaaaactcgaggtagaaatccaactttcatacagctttatcaaaatgacagtattctatggtacttttcaaatcactatttttttctcttagaggttatcaaatgaaatgaagcatttaaatatgttttctaaattcaggaatgtgagataggagagcttttgacattataggattcagcggtggaagagaaaatgaacatccagttccctttctccctaactcaagatctgtgctccctgaatatcattagtgcttctcatttcatcagtgttcaaatagtgaatcattcattcactgattgttgaaacaactgttataagatttggaaataatatacagaacatcttggaagtactttttttttattagcaagaagcagctatatgccaaaagtattaagaaggatcatctcttcagaataagtgagaagtatatcactggtaattttttagatttttgctgaatgttttagtaaaatttgggaaggtagtttttttttgagttggcaattatatgctgtccctcttgttttctcttccaaaataatcattcttctctctctctctctctctaaaatgggagccacagagccactgtcagaattgtatacatataaacctgagaacattgcctggcctggcacatagtcaatgctcaataaacatttcttgctactgtatctactgtgttctgttccccctctgttcaacaccctgtattttttcctggtggagattttcctgagtacctaaacaaataaacatagccaaacaaaacaagaattcagtgctgatgccgtgtgctttagaagctgggtctgtgcttgacttgactgacggagatgtgatactctgagtgtgtctgcagataaagccaaattcaaaattcaagtgaaacgcccttggacttgggaatgaatcggcgggtggggggggggggctttgaccaaggtactcagtgaccctgtgcttccaagttctccatctgtaacatgagtggtttgctctcagaggtttcttccacctctaaaaattaccatcattttgcaaccttgatgctttaagactttgaagtccctgtggaaaagaacctatgaaaagcggtcactgtttctgttttccccgtgcattttagtggctgcatagagtgttttttggtgtgtgtcttccatcttgctcaggtggagctaatgacctccttctccaggatagacaataaaacaaaccaaaacaaaaacactctgttcatgcacaaaggcaaccctcttccagatgcttaaccccttaaatgagtatttcgatgacacagagggatcatcacttcacttgccactgaaatacagccatctctggagtgaaatttggcagctgggaagtagtcaagctgcagtacttatatgacagtttggggaaaaggagtgagacagaaatagcagattccaaaataatcccattaaaacagcagggaaagtggaattgggcaataagatgggaggatggtttgccccaaagtctgactgtcctgtttagacaatgcggacttcagccccagaagctctaacttgtgtcactgctggaatatagtgaccacagtcaagaatcccctacacacaccccaaaaaggggggcttatctaatgtcccattgatctatcgtcttgtgatttttttttttttctctttttcctgctactctagttatcaggctgtgctggcacataaatggatctgtctttttaaagctacctcttccttttgccccctgcataagatagtgttgtaggtaagcatgttataacatcagaaagtactcagctgagaaggagtgatgttaaagcaccctttgggctggctctggaaggatgaactgactgaccagaaaggaaaactcttctgtttaattccaggatcttgggaataacagtgacagagaaagaagattcgagaagtagatgtggttgagtacaaatgtagaactcttcagattttctggaatggggtagccattgtgataaatattaggatatgagcgtggaagtcgtagtggataaatttgaaagctactcagcaatatgtgcagcaacagtttttaaaaagcaaaaggaagatttgtcaacatagttagaaatcctcagatcctcagataatggaacatcatatctctcaaaaggaagattccagggaataaagaaagcagatgataagggaacctgggcattttagtttaaccagaaaatagaacgttaccaaaaaatttagagattaaagagtcagtttcatttagaagcacataaaatgtttatgtaatgagcagaatttatagagtctactattataaaatagaaccaaaaatgaattcaagaaaaatgtaataaaattaatgtagtgggagaaaatgaaatacaatatcagaaattctagttttgaatctcagttctgcaacttatcagctttgtgaccttagggaaatcactcaaaatctgagggttttttccgcatctctataaaatagaaataattataatatctgtctcacaggggtattgtgatgatcaaatgagataatgcattgaaaatgttttgtaaattgtagagccctctacatatgctatttctataactctgcaatttcttatggcatggagtgagctctcagagacagtaatcacatgtggaaatagcttagagaagcagtcatatcagaggcaaaatctattgtataaaaatttaaaaattcatatgaattattttttctgcttctcatttttctggctcagaaattcttctatgtttacagaatttttccaaaaatattctggtaagccctgtaacagaattgtccactctctgttaagcggtaaaccacatgattttttttccttttttttttttttttttgagacagagtcttgctctgttgcccaagctggagtgcaatggcacgatctcggctcactgcaacctctgcctcccaggttcaagcaatccttttgcctcagcttcccaagtagctgggactacaggtgtgcgccactgcacctggctaatttttgtatttttagtagagatggggtttcactatgttggctaggctggtctcgaactcctggcctcaggtgatccaccctcctcggcctcccaaagggctgggattgcaggcatgagccaccgtgcccggccaaaccacaagattttatagtaaatattgcctgtgagtaaaccttgaataacaacattaaagcagaagactgctatcttgtgtcatttgataatcctaatttagggaggtctgggcagagaaaagcggggtgtgtctgtggtctggggacaagagtaatgtaagtagcatgccacatgatgaagactgaaacggagacagtgaagcacggtaaatctttactgagtgtgggctggtgtgctgaagttccctttatgcatcagcccatctgtctcattagcttctctcttaatcacaggctccatgaagtgtctacttgtctttttttagctttttatgtcaatctcctataaaagcaaaaggaagtcaactggcctttatgctgtttgtgtatactccatgcatgctcggggtggggccagctgtatttataaatgcatgctaacatgggggttactctgtgtgcataagagcttatttgtatgtgcattcatgaatatgtgtacatttgggcagatacacaaagacacaacacatatgtgcctctgctgtatgctctcttacatggaaaagacacattgacattaattagaaaaggtgatatgaaacagtgaaagtaaaattcctttcggcagtatttactattgtaattaaagtgcatgatgtaacattatatgtgcaggagaatttgcttattcatcctttagaacaatagtaggagttacatattaacaggtttaagtgtcaataagtgtctgaatacagattctctattgtgtgcagttcttgtaataaggcagtgtattttccttgtgtctttgcttgcttggaattgaaaatgctttggatgaagaatgttgcagagtgtaatttgtggcagaaaatatgcccccactgtttgtttattattcctgaggacatttgctgggctgaactatcatatgtagaaaagaacagctttgtttggaaaatactgtaagagcagtacaagaaaattgaattaagtaaagagacttagggagtccatctttctctgatgatattccttatttgctcttcattattccctgtgaaggaataaaaacgatgaaattggatttgaagactggattaagacaaatgacttttcagatttttttttttttaccttagctgtttccaattttcctagaaaagcacatagtcactatataaagagtctgagtttattgcattaaatcttcctaaatagtgtgcccttgaggtttgatgtggggaattagtttagaagattcaggggcttggagtacctgctaactgtgtgatggcgtgtgtctctagaaattttatatgcccattgatttttatagagcaagcagtacaatagaagggaagcaggatgctgcttggtcttaaggaagtctttcctgcctaccaattgccacacccctttttctccaggtagagttgactatgttttcttctgggccattgctgtacttgcctaatacttttaataaggacttgcaaatgtgcctgtaggtctcttctaactaggctgtaaaccactcggacagaggaattgttttatttcttgtaactctaacacctaacacaaggccctcaagataacctgtcaaatgaatgaacagatgagctgaatacccgctgtgtgcctgttcttgtcttaagacatgagggacaacctgtaacacaggacacaatgtggctgtgtctgctctgaaatggtagaatatctagctacagcttagaataactgggtaaggaaataaatgctggattataacccaaagaataaaatatccaacgagtccaatgaataaataaataagggaaaaggaatgactcttccctgcagcagaatttcagttaataaacaaacgaggaaggaagcagtatgaaaacatcattagaactcatagtaagaattgccacgagaaagtcccaccgatggatgcattagatgggcagatgtggattagatggattagaatgagcgggcaaaagtatatgcagaaacaggaaattcgtagaattttaaaatatccctaccccaaacatttagtaattacaaggagaaaaataaaagtttacggtgaagaatcctggcagacatcaccttaactgagtgatcaaggttaatgtcaccagtgatacatattgacatcgtgtgtcccactgagaagggcgtgtcatctctgatatcctccctgaaaaggcataatctcactctaatcaagaaaaaaatagcaaactcaaatggaaggacattcgaaaaaataactgacccctccccttaaaattgtcaaggtctttaaggataaggaaggattcaggaactgtcacagattagcagaaactaagaaatatgaccacataaaattctaagtatgatcctgaaacaggaaaaaaaaaaaaaaagcctgtttggtgcaaaaactggtgaaatcctaatacaccctacggtttgttgagtagtcgtgacccaggttaactttctagttttgatcgtggttctatggctttgtaagctgttaatatagggggaaactgggtggaaggtacaagggagctctgtactatttttgccgctttctgtaaatctaaaattatcttcaaaaaaacctagttgacacttaggtaggccgaggtgggcagatcacttgaggtcaggagatcgagaccagactggccaacatggtgaaaccccatctctactgaaaatacaaaaattaggccgggtgcggtggctcatgcctgtaatcccaacactttgggaggccgaggcgggcggatcacctgaggtcgggagttcgagaccaccctgagcaacatggagaaaccccgtttctactaaaaatacaaataaaattagctgggcatggtggcgcatgcctgtaatcccagctactcaagaggctgaggcaggagaagcacttgaaccccggaggcagaggttgcagtgagccgagatcgcgccactgcatgccagcctgggcgacagagcgagactccgtctcaaataaataaataaataaataatacaaaaattagctaggcatggtggtgtgtacctgtaatcccagctacttgggaggctgaggcaagagaattgcttgaacctggaaggcagaggttgcagtgagctgagatccggccactgcactccagcctgggtgacagagtgagactccatcaaaaaacaaaacaaaacaaaaaatctagttcagggcacaataccaatccacaggaagcaattatagagcaatccatgacaacagacaactgagaatttgtaatggggtgccagtgtcaggttcagaagaggaatgagaaatggctggggattggagtcttcaggaagagcttcctatgagaagcaaagcctgacagggaccttaacaggatgtgtagtgatgatgggtggaggaaactgaggggtcattgtaggcacagtggcagcagggacaaaagcatgaggaagggacacagatggcctgcatgggatatgttggaggggccagcggagttatatgtgcattgctggagattggtatgaaagagaatttgacagctgtggggataacagagctaaaggatcactaagacctggcggaggaatgtgaagttaatgcaggaggtgacacagagttcccagttcttgtttatggaaggggctcagtgagtttgtgtgtatatatctgaaaccggtgacaatgtatgtagggtggccagagttgggagaaacaggggacaggcgagtcaggaattaaagataggtaatgggagcctattcgtttgagggtgttgggaggatggcaggaaaggaaaagggggcaacatattcaaaggtatttgaagggataaaataatataacttagtaattgttggatttggagaatggagaggaaggagtcaaagatgatttctgggtcatatttactggacaggtactattggtgtccataactgaaataatccattcagcagatatttgcatgcctacatcgaggaataatgtattctaggtgaggaaggaggattaaaaagaatgtcaacacagcatctgcttacgctggaatgtgggccagaaagcctgtggcttaggctagactgaatgaatggccaggtcagcctacttaaggagtccctgccctccacataaaaagaagggaaagattgccctactctgttcctagcagtagccatgaacagtgttagaagatctttcaaactgacacttctgtcctcttgataaaaatgtcaggtctactgttggaccatactcataaaaactctgttaaatcaccattctacttaggaaaaggccattcatgccccacttaactctgccaagatagaggatgctgtgttcccaaggtaccaaaactgaaagttaaaatgccataaaagtatactgaactttatagaagaaaaaacagaaaaagtgtatgcatgcttaaacctcaaactcttgatcttcaggtaccatgtcttttcaacgtagataatatcacctagtgagcacaccctgaagtcatgctctggctggctttgctgtgttctttttgttttctcttgggcttgtgtctcactctgtgttgggtaggaaagggtttctgtagcctttatacccttgttttcatcacttatttcacgaatttccacttattactcaagaataaccatatttttttatctctatgacaagctgaaaacctccctgtcagcaattatagcctgttagccctcacagagtcagtcttggggaggtatggccttgcggttcaggggcagaaccgtaggtgtattcacctgtggaagacttagacatacacatttgattatgggtggcagtaatcagatttatgttttgaaggtcttcgaagatctccgtccctttctcagtcaacattatacatcattgtttcttaacagttgagtccttataccttttttggtatcagtcggtcattaggccaagtaaacattttattgacaataggcaactgaggagaaaattaaccctttttatagttaattgtaagtggaagttgcttgatattcttaaaaatatgaaattgtggaagttctggttctagtctgagaattgagcattgagcatcacctttacaacatgtagacttaaacttcaaatacctttatgatgctgagaactccccatggaataggaaccggccatggcatatctaaaacatgacttacatagcattgcacgatataatatgaatgcatgtttttttgtagaatttagaaagaggctgaacgtgatggctcacccctgcaatcccagcactttggggggctgaggtggaaggatcacttgaagccacgagtttgagaccagcctggacagcgtagtgagaccctatctctacaaaaaaaatttaaaacttagctgagcatggtggcatgagcctgtagtcctagctacttgggaggcttatgtaggaggatcacttgagtctaggagtttgaggctgcagtgagctgtgatcgcaccactacactccagcctgggtgacagaacaagtctttgtctctttaagttttttttttttaattagctgagtgtaatgttgtgagtctgtagtcctagctgctcaggaggctgaggtgggaggattgcttgagcccaggagttcaaggttacagtgagctatgattgcaccactgcacaccagtctgggtggcaaagtgagaccctgtctctagaaaaataaaataaaagaaaataatgtataaaagaatgacatcttttgtagagcggacattggaaatggcagaatactccatgaagtagcctctagattccctttatgggcttgctgtggaagcacatatgttcacattggcagaataaagactctttttatgtccttttaaactaatgtattgacttcagtattttttttatagggaacatatttcaaaattgtaatggtagtcaatggttctatgtaaaaatactttgtctttccacagacccatatataccagccaggtcaccttcattctcagagtgcctgatgagtagagtgcattcaatacaatagctgtcttgtttttttagcagcagaagtgggagtcacatgctgaactcgggaaccattttgaatttattctcatagcaattgcaaggtaaaggcaggcagaatccttgctgtgtaaccctcaacagagctccataaggattgggaaatcaggccatgctttgtcaaagagagggtgcacacaggcatcaaacaggtcacttctcttaattcttaggccaccacacaggaagcacataattatttaatccctggatctttctagagatgcaacaaagtgatgagggtggacagctccagaaaatcgctgtgcaaggagcaagggtagaaagctagggttttggattagacagactccatttcaaattacatcttaacttagtttttattgtaccctctaacaacttatgaataaaataaggggaatatatagagagttaggcgtggggaatggttacaacttatttctcttcttcactttcatctgtctttcttcagtctcttctcccctcttccattaaaggtaaactgaataaatgaatagtgaatgaatgaagtgagcaagctgttttcaacaaagttcacttggtgccacttccatggatttagttataaaagtgatatgatcctagttatcttaggcagaatacatatttctgtgaccctaatctacgtgggtcctacttgaaacctggaaatgataggaaaaaccttcttgggaaggagaaaaatgaccaataaaaaaattctgaattatacttatagatgaagccctggtgaacccagagccctgttgactcacaaggacactcaaagtaagattagtgattcaacacattcacttcttcagtttcccaaatagattagaaggaataagagggctttcttgggttaaacttactaaccacagtgaaggaaggagaaaacctataaaaacttgaagtattataaaatctcagcggtgtgaggccatttcgtttgaggacaaacaaacctagtggattgtccagggcaggtgaatgtaaaggacatttcctgagatgcaacaaagagatgatggtacaatgggcaaggatgttgcaataacaagcaaccccaactcttcagggtggaacacagtagaagttcctttttgatggtgttacggataacttggggtgttctgcagttggagagggcgtctgtatggtggtgattccctgacccagggtccttgtatcgcaaggctcagacattccctcagtgttgggagaccctaaggatcttctgcacctggcagaagagagaagtggggaagcgagagagtgagcagtctcctgggaggtttgttggtgaaattggcatataccacttccttccatgttcccttgaccagaatttagtcatgtggacatagtcaactgcaggtaaagtggagaattgtcagcctgtatgtcaaggagtacagggaaactgttttttcaacaactaaccagtttctgccacaactggataccttcctgacgtcatctttactcccatcccagccccacccgagatttggccatgagtaccctgtaatttgcagggcattatatctctgtctcaggaacagcaggagaccactgagtcaatcggaactgttttttttttttttttttctgagacggagtctcactctgtcgcccaggctggagtgcagtggtgtgagcttggctcactacagcctccacctcctgggttcaagcgattctcctgtcttagcctccccagtagctaggattacaaggctcacaccaccatgcccagctaaattttttattttttatttttagcagagacgaggtttcaccatgttggtcaggctggtctcgaactcctgacctcaggtgatccgcccaccttggcctcccaaagtgctgggattacaggcgtgagccaccaccacgccaggccaggactcttcatcttttaaaccacccgggtctgaactgacagtcccttatgttatcttcatgggaagaagagcaggcagtcatgtgtggctccccatgaaaaggcaaggaaccttctagatactgccgctagaaaccaggtgtgggatagaagccctgcctttgatctatacctgttggtcaggaacctgcttctactttacttcattcatctgcacttcttaggagctgggtcctgttcttgtttaccattactaaattacggggaaattcctgaaattatccagtcctcccagatggttcattctttgtgtgtatacccagagcttggtcatgtccccattcctctctctcaagattagatctgctgtcaaaacctagaaacaagtctttactgaactgaactctttattagcctttgattgccagataactggacttgggaaggggagtttgggaaaaagggttaactatattaaatttttttggtgctctcttatatgggctgggatgaagcatttagacagtgggagaagtataggagaggcagacagatgccagaaaaaaaaaactttggttgtttccaggtaccgaaaaagaaagttcatttgtaagtcacccacctcctcatgatttcttcacctcctgtcccctgctcatggtactagagtttgtctatattataagctctatagctctttttgccttcctgcaaaactaagcactatttataacactgtttctctgagaaaatgtgtttggagtttcaaataaatgacttacaaatgaactttctgtatacaactcattcatacattgagaactgcctgtaccgggcatgtaacctggagataacttttatctctgctttatcaatatgggcttgtcaggttgacttatgtgtacttctctctgccttcgttttgatgatagcctctctcttaaaatttaatactctctttatgtttggagaaacattccctttggcagcgtttcaaatattcttgcgaattggaatagtgattttattttatctcccaatgtatctttaataggattcatggctatgaaaatcttttgcacagtccgcctataaattgtagaaaaattgagaactatttaaaagaagggggcgcagaaataatccttttctagtattactctgggttgtcagatatctttgcaatataattactgtgttggtttttaaaggttaaaagagctctgacgtttataattctcttttgtgtgtgtgttctacacatataaggggaaaatctaacacatggaaggaaaatactttagttaacataaaggtcctgagcattttatggtttttcaatacagagacataattcatggattttatatttgcttttacagatatctggtgaatcagttatttgctctgtggaaccaatttgcagtttacacaccttgtttatttctaagctgtgtgcatgggtaatgtgtgcacaaaaatactcttgctgacattagattgtaaagtaaaaaggcggaacactggtcctggagatatgccttctcagggaacttactatccatatacaagtaaaaatttctcattgttagcagagcagctgacagaatatgatcacaaatgttgctgatgctgttctgttaggaggtagaaatagaatgcctaggactatgcaagcttgtcagagttagattgtcagggtgatgtgcttccatattaaaaagaatactttgttcccccctcacacatgcacccttgcagtggaaagaaacatttatttcagaataagcgcaagttattctgacttgcactcacaggctcagactttgatgccagtgtagttaaaatttagtgaataccagtcatgtttaatggtctttcccttctgtttaaaacagtactgcagcccatgcaagaaacatttccctttaattttatgcattttgtggtatcttttgatggtttttctctactgtcaaaactgtgagaataatttcaatggcatgttttttctgccatcttcagttggcagtcatatccccccagattgtcctcatagattccagatcacctttatgtttaatcttcattaattgacaagtacctttgaaagggttttgcaaaaattgaactgcaaagctgtgatttaatacaaggaaggctacatcagtgtgaaagaaagcactttatgaactgtagagtactatttaaaggtgaggcattataattaaatatgctcaggttgttactgagcattgaatgccaaagcatatgaaagacaacttacgatgccaggagtttgagactagcctaggcaacacagtgaggacccacctctacaaaatgtttttgttgttgttgttgttgttgttgtttttgagacggagtctcactctgttgcccaggctggagtgcagtggtgtgatctcggctcactgcaacctttgcctcccagattcaagcgattctcctgcctcagcctcccgagtagctgagattacaggaacccaccaccatgcccggctaatttttttttgtatttttagtagagacggggtttcacagtgttcgccaggatggtcttgatctcctgacctcgtgatccgcccgccgtggcctcccaaagtgctgggattacagtcgtgagccaccgcgcccagcctgtttgtttgtttgtttgtttgttttttaattggccaggcatggtgagatgtgcttatagtccagctactctggaggctgaggcgggaggatcgcttgagcccaggagtttgagattacagcaatgttatgagagtagctagaagttacaccaatgctgcaggagtttgggggaatccagagttgtaaaatgccaacaaaaattattaattaaggggatctcttagccgtctctttgaccctacaaaaaacatggtggtactgagttttttagcctcacccaagcaaaaacagaatagggcattgtatttcttatatctggatgcaaaaacatgaaatgttaattgtagattataagtcattaagtgtcacggatttatgttttatgacaagttggagtttacagatttctaggctatttttttcacatagagatacatgaaagctttattcttgttattcaacgtaaatcttttataatctgctctcaatttccagtatcctgaaaaatcctttttctctcttttttgagacccttccctccccctaccatccagagtcatgcagttaacagttctgatagtgcttggattcatttgtagattgtacataccaaatggagctggcacctcttcatggaaattggacccagtgggctattttacacttgccggatgtgctttcctcagtagaagtttatattttatagctgatactccattgaccatagtaacctgttataaaacatgatgttttatcatttgttctgtgtcttcagggctgaacattttatggagagactttattaacatttaaagagactttattaaccctagatattaacatggtttacctggaaattttttgagcaatgttttcatttgattcctggaatgttcaaatagcaaaggcagtttctgttggtgtgcatgtgtgtgtttgtggttaaaagccagcattacccagagaccttctggttcatgtggaaattattattattactatgattattgttatttttgcaaatgaataaattgtcattctgatttttttaacctcaacgttcctttaaaaacactgttgatttttatggagaaggttgatttcctggaagtaataatatgatgttagagattactttttaggcaatattttggcatgtttatcagataaatcaaacatcaaataaatagattatggggaatgatttttcagtaatctctttttgcagtttcttccctaaacaaaatgatgtggcctattaggtggattggtttggaggacaattgcttacagggaccctgtccttatggtgtggagaagcagaaaaaactcacagtactccagagtagcccccttattctttttcataaacttcaaactaggtatgaaagacctgtccactttaaagctttcgcctgtgaagataaagcagagattgatttttaaccactatgctcatatggggaaacagaatgcaggagctaagatttaaagaagcagatgggaagaagagaaataacctcctctggcatccacctggaaatgtctcctgagaaagaggatggacatcttctgatattcataagtcaaggaactgcttgaattctgtattccgtgtacagtattctacctatcaagaccctcacccagggaagaaagtcttgtttattcaggagatggggagcaggaggcattgaggactgcatagcttatttaaattaaaaaaaaaagtgcaatgaattgctttttagtgtatttacagagctgtgcagctatcaccacaataaattttagaacattttcatcacccctaaaggaaatcccatacccatcagcaatcacttcccattttcccccaatcctctaccctcagctcctggcaaccacgaagctgtttctctatatatagatttgcttgttctagacattccatataaatagaatcatgcaatatgcggacttctgtgactgacttctttcacttagcataatgctttcaaggatcatccacatttcagcatacatcagtcattcatttcttgttatgatggaataatgtaacattgtatggctataccttattttgtttattcatttatcagttgatggacatttgggttgtctccactctttcactattatgaacagtgctgctatgaacattcctttccaagtttttgtgtagacatagtttcatttctctgtgcagcctacttttaggtagttacaaattaagattgtaagtgatttttttttcattttacacatttgttcgcttcacgatggcctcctctctcttcttacctatctcactctcccaaaaatgatttttcttgagaacatagttgtagaagggtaagaatatcaaccaacttttgctaagtatgaatgcccaggcgctctgctaagcatcatgtatgtgttacaatgtttctcactttatagacgggggctgaggtttagagaggctgctaagcctggaggtcattcagctgaaaaggtagaagagctgggatttggacccacatcctgtttactcagcaaggtccatgctgtctgttgactccctcatgatatgatcccagatcatacacctgttgaaatcttagagaattctctttctattcgtgagcttctcccaattgtatcctaaaaagtaaggaatataaatcagatgctccgtcctaagcccttggacctggagcgggcatttgtgttccccgttgacaaaaagatgatgaaatacttcctctgtgtctgagtgcagcggcgtcatggaccggtgttaagtttaacctgacccttctctctgccctgcagttgcttcatctcctcaccttaagacttcacctttccttcatttcagcttcccagagatactgccacaccccggacctgtgtatcaacttgaaccctcacaccccccaacttggacctttctaaatcttaaaatctcagactctgtagttctctctgggcatagcctcctgacccccttgctttccctctcttcctcagaactcagttgtctccttattgtgagccctgactcatcccccactcttggtcactatagccactttcttcaggctccgtattcctgccccctaaccagcctagacctcatggcttgaaagtttaactgtgcatgcccaatagcttagtgccatgcattcctttccaggcaccaatcctgcatgatccccatcacctgcacagctgcttagaggcccccaaacccaactgatgggtcctgatgtaaattcttactgttaatctgaggagagtcatcattgcttttctagtgggctcatagtcacatttcttatgggatctattccaaacttttccagtctcttcaaaacttaccctcaccctcactttggtagaggaccatttattcatcttgcttttttaaaatcttgaagaatccaggcatgaatccttctactctctttttccctttaattctgtccgttgctcctgtctcacagttgcagacaagtgttgcatgctgtgctcacgcatcccagaggagcaagaagacctcccactccgcaaggctccaagacccctcgttttctggatccctctctaccctgacttctctgaggctttgtcacctaggttatctccctctcctgcttgatctttcattatcttcatcttaaccaaaaccttctcttcagtctatgaatgtgcctagtggtgtggcctgtcttttaaaaactaaaggagcccttattttgaccttgttctcctcaggcaatttccatttctctattctttctttaacctcaacatgttttgaaaacatagtctgtgttctattcatccagattattaccacccactgaagtcttagtcaccagttcttctctgtcatccaagcactggaaacttctcggcccaatgtcttcactggcctaagatggactcaaactagtaagcttttattcagtggttactcctagacctctgggctgtatttcctacggtggctgctgccagccatttcatttcttttcttttctttttcttttgtttcttttcttttctttttcctttcctttcctttcctttcctctcctctcctctcctctcctctcctctccttttctttcttttcttttcttctccttccccttccccattccccttctttcttctttcttcttcttctttttttttttttttgagacaagatctagctctgttgcccaggctggagtacagtggggtgatcttggctcactgcaacctctgcctcccgggctcaagtgatcttcccatctcagcctcccaaatagctgggactacaggtgcaggccaccacacctggctaatttttgtattttttgtagaggcagggttttgctgtgttgcccaggctggtctccaactctgagctcaagcaatccgcctgcctcggcctcccaaagtgctgggattacaggtgtgagccactgcatcagcctatttgtttctgaaaacactctttatctgcctttattttctcttaccctctactgctctgatcatttcttctttatgtcttccttcttttgtcccttttcgtacttattcttaaaagtagattctgcctaagtgtgtataaccacttttcttccttgtttacatcttccaggtcctgagggagtgttgtgacttggttacagcctaccttcctaaccttactcattgcagcccaggcttccccataattatatacatgttcctctcacacctcaagctcccttggttttctgcttctgttgcatctctggtttctttcacctaggatcatcctcctgcctcccctctctgcatttctatatattcttttccaggaccacatcaaattctgtgttctccttatgacataatctcaaatgaccccaggaagttatcttttttttggtccacatttttaatgggacctttcttacttttacttggttttcaaattatttgttgaaacacatttcttttaaactatgtactcatgagacagtatattgagaatttaacccctgtccttaaacacagtaaatattgtgtcaatgtttgctaaatgaaaggagtgaaaagtatggctctatgggaacttgttggtgaatgtcccatttttatttaccaatgaagaaaagcaaaacttagcaaaatgtatctgtggagaggtgggtgggagagggttgttgtatagtctgaaccaaaataattaactcctgtaattgcaaaaatattatcattgctcagtgcaccattttgcagttaatcagatagttttagggaaatattaaatgattctcaagcttggaaaatagcaatgagtgttatggcatcactatacagcccagaatgaactcatggatcctccaatctcttgtatcagatatactgcatactggatacccaaggcatcagggattcagagaaatttttccgaaggtcatctgggtaggaagcctgacttttatagaatatttcataaaattctttttattttatttttcaatagtttctctacattgtatacaaagcacactaattactcactcccattgtctccactaattacatcactcccattttgttctcctatgaacaaagaagaaaggaacaagaggttgttttttcattttgaagaggcaaggttgatatgtttgactaaaataaagttgggattacctgtgaatttcagccagctttgccctccggtccatcaggtggacagtggaaaattgactgtgatgctaaaaatggtcataattgggggaaagtaagctttaccacctcttttgtgatgctgaatgtgtcttcaagggaatcaaaaaagttgtgcttgacaggcaaggtgaaaaacccagggatttgctacaagaatctctgcaggagtggtagaatgagaagcttcattggagtctgggacattttagtgttgctggcccattaccctgaacactcttctaacctcctccaagacgggtgtctgagaggagctgggccctgcagaccaattctagtcttctctctccacccctgccccctttagaacaagcatattaaaggaatgtctgatgagctcactatagtctttgtcaggacattttattttttatttttttatttttatttttgaggtggagtttcgctcttgctatccaaactggagtgcaatggtgtgatctcggtgcactgcaacctccgcctccccgtttaaacgattctcctgcctcagcctcccgagtagctgggattacaagcacctgccaccatgcccagcaaatttttgtatttttagtagagacggggtttcaccatgttggccaggctggtctccagctcctgtcaggacatttttacagctgttttcgttctaaccctaactgatgaccattggaagacctaaaaattcagctacgcagaataagtaaaattggtctttttctttgcatcctgaggataaatctaaacaaacccctctcgttggcatatctccagctacaacagagggcaaatttgaatggattatgaagattgaattatccacttggtcttggaggtggtcccgtctcctgtgatggtggggtggggaggcggtgcagacatgtgtacaggaagcttagccaaatgcctctatttgggaaaagttgaaatcagtttcctgggcagtcaattttgagggtttaaaaaactttattttttttttattaaacatactaaaaataacaaagctatccaaaattagaccacgtactttgctccttttatatttcagtgtccttggtatgcttggtttcttttctttctttttgaagcattaatattgttttgaattgctagatatacagaaggtacgatagatgtacaaggaaaaataagcatctctcttatttctgtgtctaagtcacttgaattctcacctagaagcaagtaccattatcattttcttgtgagtccttttaaggatattttatgattatataagcaaaaatataggttttttaaaacaatgtttacaccccatacactattctgccctttacctcttttcacctaacagtgtgtcctggaaaacctttcttatcggaacatagaacagccttattcttttttagtatctaaatagtattcgattgtatgattttgccataaagtattcagtcccacattgatggactttttttttttttttggttgtttccagtcacttgctactatgaacaatgcttcagtgaacaactctctataaatagcatgttgtatgtcagcaaggatctctggaggagaaattactaaaggggaattgttggatcaaaaggaatatgcagttttaattttggtaaaccttgccaaattgccctccaatttggcattcgtcctattgtatgttcctgctagcactgtttgagtgtgcttttctccacagacgatgtttttaaacttcacgatctttgccaatctgagaggtgaaaactactatattctagtagctttaatatgggtttctgttattatagtggtggttgaatatactttcatatgtttaaaagccgttcctattttcttttctgggaaatgtatattcatcctcgttgcccatttttctactacgtttttggtttatcctgtgaattgacttttttttttaggagcatgtaacagctaaaaagattagtccttttgtcttatgctattttagtttaaatttttccgtttgtcttttgactttatgttttcttcatgcagggttttaaaaaattaaagtcatcttatttatcagatttttattttttggcttttaatttttttacatacttaggtctcttctacgcagtaattataatttttaaattgtctcgtattttttattagtattttaaaaataatagttttggccaggcacaatggttcatgcctgtaatcccagcactttgggaggccaaggcgagagcatcacttgaggccaggagttagagaccagtctggacaacacagggagaccctgtttttacataataataataataaatagccaaacatggtggcgcacgcctgtttgtactcgggaggctgaggtggaaggattgtttgagcccaggagtttgagactgcagtgagttatggtcgtgctactacactccagcctgggtgacagagtgagaccctgtctctaaaagaaaataaaaattaaaaaggttttattgagatatgattcatatatcgtaaaacttaccttttttttttcttttttttttttttttttgacacaggatctcgctctgtcacccaggctggagtgcagtggtgcagtcacagcttactgcaacctggaactcctgggctcaagcagcctcctgccttagccttctaaagtgctaggattacaggtgtgagccactgtgcccagccacaatgcagtcttttaataaatgggtttttaatctattcatagaattatacaatcatcatcaaaacctaattttacattttcattactccaaaaagaaaacctttacccattaagcacccactcccccatttcctctaccttctggcccctggtatccacttaatctatgttttatctctatggatttgcctgtcctagacatctcatataaatggaaccatataatgtgtggccttacacaactgacttttccacttagcgtaatgttttcaaggttctttctcatatttttatgctttcattttttacgttcaaatctttggtcaccttgggatttattttagtgcaggatgtgaattagggatctatatttttttaggtggccgtccaattattggaagtccttcctcccactaaagtgcagtgacacccatatcattcactgaagtccagtattcatttggatcgacctcttttctgttgaccttgctaagtattcctgtgcccatgcacactgttttactttctaaggctttataatatttttaatatcggtatggtattcttttcttatttctttttatatcattgttatggccattctttcctgtttatttttccataggaacttcagaattagctttctaatttgtatttttgacatcatataagtttatagataaatatagaaagaattattctcttgatattgactttctattcaagaagaagatagacctttgcagttgttcctatctcctcctctgtccctcagtagtatttaacattcttctttatgtagatttgttttttttttttttttttttgaaatggggtttcactctgtttcccaggctaaagtgcagtggcacaatcttggctcactgaaacctctggctcccaggttcaagcgattcttgtgccttagcctccccagtaactgggactacaggtgtctgccaccacacctggctaatttttttgtatttttagtagagacggcgttttaccatgtttggttaggctggtctcgaactcctgacctcaagtgatctgcccacctcgccctcccaaagtgctggaataataggcctgagccactgcacccagccctctttatgtagatcttgcatatagtcctccttcagtttatccctaggcattttatatttttgttgttatttaaatatgggatacctttttactggttgtcctttagaaaggttattgatttttgtatattcttttgtttcagttaccctacagaattctctaattaataagttgttcaattgacttgctcagatcatagcatttataaataataatttttctgcctgttataatttttatatcccttatttatttctcttatgcagttaaattggctaagtttaacagatcagtgttaaataacagagatgatggtagacatcctcatgttgttcctatttttaatgggatgcttctcatgttcccccattaacagtgagcctgcctttggggtggagcctgtttattgtccatttggcgtttgtagggcttttataatgagtagaaaacgttttggaaatgctgaatctgacggaattatttgcagaaaggtaaagtatgctgtgttagttctcccgcagtgataaaatagtagtctgatttttcttaccagcattgacaggagtttatgagtgggaagtctgtgctataaaggaagaaggcagcaattgtattttaatctcatgctatttttcttttgccaacgaagtaaaaagactaagaagctataggaatatgtagtaaaggcttttgctaagagagaaaaggaagaaaggtggaagaatgggatggaagaaacgagataaaagtatacctcattttcctcagcgtccccccagatcaagtcacctgataaaccaaatattactagggtagtttttttccccaaaatattattaccaaaaaatgacacaaaacactaattgtcaaccaaaatgataaagagtctccgaaaaggcttgcaagaaaatagtgaaatattttatcatttgtaagcaaaagataataatacagagttccaaatactgagaaaccacaagaggaaaaagaatgcctattgaaacatgtttatatgttgattctttttgatggtgccattaaagaaaaaagaatgttttgatctcttgcaaagaaagccaaactagagaggtattttatgagctaaccccaaacctgacattactctagtaataaataccaggacaggctgtcccttgcattagcagaactggaaaacaaaacaaaagacagtaacaattgaggctttgatgcttgttggaaacatctaacatacagagttagtgtgttgtggtcataaacaaaaggagtttaggctgactccataaattagggaaactgatgcgtcctgttgcttgggacacactacacaattatctgcatgacaggcaggaaagaaagcactggaaggcaaacagactgcagaacaatgtggccacccagttggttttagacacacacacccctggcctgcagaggtgtctatttgacagccggtctcatgtcaaaactttcttttatgtgattttccgattgtaggaaccactgggctctgggtgggtgtcttaggcgagtctgccttagtgttgagtttgacatatggtagcattgttaggtggtgtgtttaggagaagccaaccagggcctcagagccaaaagcatggagctcactggctgtgtgaacttgaccaagctactgaacttttctgagcctagtttgtcatctgcaagtaatgcctacagttcacggcttttgtatgtacttatgagatgttgtacatctagcacctcacatggggcttgtagagagcagttgctcaggcagtgtttgtaagtggagcacaggaagcaagggatggaaagagtatcacatcaggaccaaggatgaaggagtgtttgtaggaaagacctccgagatgatggttgagatggattatgtacaataaacaggaagcatgttcttgggaagtgcttctaagcatagaagggcagcattttcaaaggcatgggtgtggaggaatctttgaaacccagggaactgtagtagagcatggctcagtcccagggtatgagatggggagtttcactcattgagacaggacagatgagccagcgtgggattgagtggggactcgtgtatcctgttcagactatagtcacgatgatggagagtcgttaaaggctgtagacatggccaggcatagtggctcatgcttgtaatctcagcactttgggaggctgaggcgggtgcatcacctgaggtcaggagttcgagaccagcctagccaacatggtgaaaccctatctctactaaaaatacaaaaaaattagccgggcgtggtggcatgtgcctgtaatcccagcactttgggacgctgaggtgggtgcatcacctgaggtcaggagttcgagactagcctggccaacatggtgaaaccccatctctactaaaaatacaaaaaaattagccgggcgtggtggcgggcgcctgtaatctcagctactcaggaggctgaggcaggagaattgcttgaatctgggagctggaggttgcagtgagccaagaccgcaccattgcactccagcctgggcgacaagaaccaaactccatctcaaaaaataaaaaagctgtagacatgagggacagcatttcatttgcattttggaaatgtgacagtaatgtctctcgggtgggtttagagattggggaggaaatgagctctggcccagggtaatgatttcttccatattttccacaaatcttagcacagggctaaacgcatagtagatttttagggaaaacctcttgatggccttgaacaaaagttattgttttgccaggatcatcttttccatgaatcacttgttataccattagtagattattcttgtgtggagttgatcattttagcccccaaattatttttgtccctcgattacatcatcttaaacgattgtgtgttgtggcatagacatatcctaatctacttacaatttatggtgcaagtatctgtgtcataaaagatatcttcttctttaaaatatgctagcctagcactccatgaaaatggagactcacagtgctgccctgtccttcaaagatgtttatgtacaaagggataactgttcccacccctaaatgctttaggctttgcctatactgcctttcaaagctttccctattttaagattttttgaggccccttggatctctggaaggagaaagctataatagcttttggtttctgattgtctttaagcagagaaaactcacagtctcatttaggggcgtgacacattcctagtagggatggtcagtcccaggcaatagctgtggccatgggctgttgagggccatggtgagggcccatgcggtaacagacagtggtatgcatgctggactggggtgagtaaatagccattattcagaaccacggattctattttcaatcagtctgtcaactgatatttttgagagtctgccatgtaccaagcagagtgctaagttctgaagatactaaggtagacaagataaaaatggcccctacccacatggcactacattatagttattataggagagtggatagaacatatctagtcaattaccgtgcactgagaaaggtactgtgagacggaaatacaaagtatggtggaagcatcctggagtgacaactgaccctcacttggaaggccatgcaggacttccatgagggtcaagagtttcctgaacccggacaggagcaagatctaccttagagaggtttggggtgaaataacgccatgaaagggatagtctttaatctagaaggaaaaatggagtattacacatttgtaataagtgttcgagatagcctttgagtcatacagtatttggaatgtatgcttggctgtcagtgatcttataagacccaaaccacagttttctttatgctgtgtcctggcgctgccaatggccagctggaagggccatggcagggtagccacgtagagaggccacctcctagaggcgcatagcctgaacgaaagcggaatttgaacaacacctccgaaaagattggaaagtcatggtatctgtgcgattgcccacaaggaggtctcctgaagtcgaagccctttggttctctggcgttttaatgatttgctattctgtcatcggaaatacgtggagcagccacatccttagacagaagaggcccagccacgttgctctggagtagaatttagtatgagtgtgagtggaagttaaacagatgtggaagcgcagagtgcagctgaacatcattgacatggaccagcaggtaaacagacttcaaggtgatacacccccgtaaggcaatgttctggccagctccgccagtcaaggctgtacagcggatagtaattatttctgtcacagcgaagatagatgctggatgtgggcagatgggggtagacttgtgaaaagtgtgagtatctttgagtatcttttataaatttagtgagtggagtggcaacccacctacacttctaatttttgctgttggaagctatgtccagaaaagagaagagaaatttctctacctgataaattacaccttattcaaaacacactgtgtgaatgaaggtgctgcttcgtcttctctctgctaacgtaacgttgtgcacaatattttttcttttgaagcagcagaaggacattttaatagaaaaatacctttactcctgttaaaggagtatcttggagttcttcacctgtctttatgggggacactccccactacatggcttcataaggatttagggatgacttgctcattagacatagagtgagctggttagaaagacaagtgtgagttggggtacagtggcatagaatgtttaaaatattgagcaatttaggatccttattctggactttaattgtttctagagccagcctctccacgtgtgagtagcatctttgagtggcaagaaaaccattctgggttgtcattgagagcatgtgtccttggagagtgccttagcagtacctcctgtgtcctcccacgacacatatccacctatgcacacgtccaccatcctatacgcacacaggtgcatcttgcagtttcacagcccgagcacagccagagagaaatgactaacatagacttgatttttcgatttaaagacgctcctctttttgctcttcctcttgaatatgacttttcttttccttattttcagtgttttcaagggaaatgtcaaattttcagacccgtaacttctgctagaatcacagaccattagggactgtagagatctaacatgcccagctggaagcgccacagcaggatagctgtgtagagacgtgcagcaggcattcagaaaaacagatctgcatcttggaaagagaggtcagggctcgacttgtggatttcagagtcactcacttagaagcagtagacatagtacacatctaatgaaagcattcccctgctcggaaatcttcagaagtccctcagattttacagaatcaactcaaattactcagcaagacctttgacaccctccaccatgtaacctcttctttcctcctctcccacttctgtctccccacacacatacacctccaaccgcaatggtctcttgaacatattagcacacgtttcttcccactttttctcaagctgttttatttctttagcattagctcagattccacttccttctggaatctttctttcatgaattcagatcgtgaaagaccaaagggaatgttggggcctgtcatgaattagaaaatatattctctgttttcaccaatcacaagtcttgtatgacttgcctagaatagcttcctttatgtgttctaagggatatgggagcccgtctagactggcctccttcacagcgctgggatccgttctgcaaacccatcacagaaatacatgtggcttcttcctgcagtaaaatatgtaggaacttatccaagatttttctttttattcttcatttatgttattttatctccagtgttatgtctccaaggatgttaggttgaattatcccctctgaaaagccatactagtttttgaattaggatgcagtgattctaacttcaggtccactgtcaactcattagtttatttaggcaagttgcataacctctgccttaatttatcatctgtaaaatggggctaggagtaactcatgatttttataaggaaaaataagacctgaagttaaaacattttggaaaatgttttcaaatatggaatacaaacatgaggtgatattattgctaccatattgcttatagtcaagaaaaaaacttaatcctttttgataatctaatacagactgtgtcatactatatgttgcaaaaaatgtatagaacttgacattcgaagagatgagtattttggctctgtggtttattagctgtgtgtccatggctgacttacctaacctttttgagcttcagtttcttttctataaattgggaataattatgttactatttattagggttgttaagtaattatattctgcaactattatgcatgaaaggcacttttaaaactacagaagagcatagtcaacagtaaccatcatggtctcacttatggcctaataattatgcctactgtagaaatagatcaaaatgtatttggattcccttttctaggataccctctcagattgtcccaaatatacaagggatgaaagaagaaggaacaagtgtgggctgaatatgcagaagaggatggaaagttgacaggagcatgtggttggaagaggccatgttgacatgcagattgtgtgatagccacattgccagagctgagagggtgcaggagggaaggcaagagggaagccttggtatccatgtaaaaccagtgaccacttgctagggtgtgtccataagcattgcatgcctattctttttttttttttttttttgtattttatttatttattttactttaagttctggggtacatatgtagaacatgcaggtctgttgcataggtatacatgtgttctggtggtttgctgcacctattaacctgtcatctaggttccctcccctccccaccccagtccccaacagaccccggtgtgtgttgttccccttcctgtgtccatgtgttctcatttttcaactcccacttatgagtgagaatggcatgcctattcctttttttttttttttttttttgagacagagtttcgctcttgttgcccaggctggagtgcaatggtgcgatctcggctcaccacaatctttgctcctgagttcaagttattctactgcctgagcctcctgagtagctgggattacgggcatgcacctccatgccctgctaattttgcatttttagtagagacggggtttcaccatgttggtcaggctggtctcgaactcccagcctcaggtgatccgcccatctctgcctcccaaagtgctgggattacaggcgtaagccgctgcacctggccagcatgcctattcttgaatgtgccctttaagcagtagtggacaacctggggcatcggtggtatcctctgtgggacaacagacacctatatgggagctggttccgcttccctcacttatggctttttacagccatgtgccgcataacgacatttgggtcaacagtgggtcacatatatcatgatagtcccataagattataatgaagctgaagaatttttatcgcctagtaatgttgtagccattgtaatgtcctagtgcaactcattactcatatgtttgctgtgatgctgcaaccctactgtgctgccagtcatgtaagagtagagcacatgcaattcggtacagcacataatgcttgataatggtaataaacaactgttattggtttatgcacttactatactatacttttgatcattgttttagactgtatttcttctacttatttaaaaaaaaaaaagttaactgcaaaccaacttcaggcaggtccttccatagatgtgtaagaagaaggcactgttgtcataggagatgacaggtccatgtgtgttattgccctgaagacctctcagtgggacaagatgtggaggtagaggtgatatgaatgatcctgaccctgtataggcctagactaatgcgtgtttgtttcttagtattttattttgtttgctatttatgtatttatttatttattgagacagccttactttgtcgcccaggctggagtgcagtggtgcaatctctgctcactgcaacctctgcctcctgggttcaagccattctcctgcctcagcctcctgagtagctgggattacaggcatgcaccaccacgccggctaatttttgtatttttagcagagacggagttttactctgttggtcaggctggtctcaaactcctggcctcaagcaatccacccgcctcggcctcccaaagtgctgggattacaggtgtgcaccactgctcctgccttagtattgttttaaaaaaaaaagtttaaaattttttaaaaatgaaaatagaaaaatgtttattgaataaagatataaaagaagaaaatattttcgtacaactttaaagtggatgatgttttaagctaagtattattacaagagtcgaaaagttttaaataatgtgtttataaagtaaaaaagttacagtaagctaagtttaatttattattgaagaaagaaatttcaaaaataaatttggtgcagcctaagtgtatacagtgtttataaagtctgcagtagtgtacagtaatgtcctaggccttcacattcgctcaccacccactcactgactcacccagagcaacttccaatcctgcaagctccattcatgggaagtgccctatacaggtgtaccatattttatcttttctgcttcattttgactgtatcttttctatatttaggtatgtttgaatgcacaaatacttaccattgtaatacatttgcctgcagtattcagtacagtatcatgcagtgtaggtttgtagccgggaagcaatacattgtaccatgtagcctagatgtgtagtaggctgtcccatctaggtttgtgtgagtagactctacgatgttcacacaacagaatcacgtgaagatgcatttctcagagcatagcccaccgctacccaacacatgcctgtaggtgaggatgaggaggtatctgtgttaaactgtgtcccccaccaaaatgttgacaggctaaacctcccagtgtccatgaacaatggctttatttggaaggagattttgcatatgaccaagttcagatgaggttattagagtgggctctaatctgatatgactcatctccttgtaaaaaggggaaacttgggctcagagatagcctccctctgaggctattaccgtgtaaagactggagttatgctgcccaaagccaagaaacaccaaagatatccggaaagccaccagaagctgggagaggggcatggaacagattctcctttgcacctcctggaaggaaccagccctgcagacaccttgatctcggatttctagcctccaggactgtaagacaatgcatttctattgttgaagccccccagtctgtggtactgtgttattgcaaccccaggaaactaacacaggcaggtagaccatccacacacaccaccgcttctctctgacgcctggtgcacagcttgggtcttgtggtgagactccacatggtaggcatttgctggcggtggatgttaaaaatgacaagatttcctctggtttgacttttgaaagcaggtgcattgaaagccaaatctcagggtttggggttggtttagaatgggatttctgaaacattctaattgtctcattgccatcacctccccaaatactgtatctttatgtgcatttggaaggaaaaggagtgcaattgaacagtatatttccgtctgttaggcaaaaccttttatttgcttcttatttttccaggcttggacactttcgtgagaatatttgcagttctgttgtaagtccacttcggtcagggatttggcaagtccacaacaaagagagggaatgtttcttttcccttttcccactttccttgggcttgcctgttctttctctgaaagatgctagaacttccccaaggggagggcctgcctttttcctccttgggaaatgttgatttatattatatgaaacatttgtttttcatagaaacttccatttcagcatgttgaaatagttggttctaatttttatgtgaaaaataaataaacttgtcgtggcaatactctcagggtacagttacataataactatgtatgcctccccaccactcattaacataggagatctcacctcacggaagtcatctcatagtctaagctttatggcttctaacagcttttacgaaactccatgaaaataccttaaacataactgttacaagttgaaagtcaaccctttttataagtatgtcagaagtaattatatcttgtagtagcaatttcatatctctacttatagttgggacaattaaggctcagaaaaatggcaaagctgagattaaaattcaggattttctgatttctagccaatgtcatgctcattttctgtgttaattttatggctcagggtccagttaaaaacgtctgaagggagtggtaagtacaagagagatgggagttgggggtggggcttgaaggagagcacacctggccccaggtgacaagactgggctccagccctgcctcatcacagttggacatgatggccctgggtcatttgacttttgaggacctcaggaaaatgagggagcttaaaaaattctatggttcctaatgaaatacttagggatgaaattacagttctgggatttgcttgaagacacaatcagccatggtttgtcactgttgatgctgagtaatggatatttggtgttctattgtgagtctttggtacatgtttggaattttccatgaaaaaaccttctgcttctaaaatgcacaccttgattcttcccatcgccctcctactggctggtcctgtgcagctcactcatttctcaggaacagcagcagactcactactctgaaggaaagaaagccctttgctttggtctgttcctaatgtacatattattagagacttttccgacaccctccccattttttatttcttaacagctaatacgatagctgtgctttcataataaattcaaaagctgctctctatttctcaccagtttgaattgtagaaaagagtacaaaagattagagtactttaaaataaatctcagctaattatacatacaactgcattcactaaatgtgaatattttcaggctttctttgctaccaagtgccacctgctcatgatttaaatgggcacaaatttagttccattaaacaaaatgcagcaactcttctcctatagcgcaaactcctttaggtcctattttgaaactgagaagctaattccagtgttctcttgttagctctcggtccatgtcaaccaccccacaaggttgtttacttgaatagtttgcagccttgctttaaaagttctagtaggcaaataggtttgttgatgatgaagtggtttgtgttttataagagtccttatggtctagatggcatttgaacttgtggttccagtgattaccaggaccctgaattgaagaatacatgctgtggccttttcagctcaggaaactttttactttctattgccaaaaaaaaaaaagacaagaaatccttcctcaaaatgttatgtgttcttagcccatacaactgtctccccagaagtcactggactcaaacctccactttgctacttgaacatattaaggtcatttaaggagaattcattcatctcctattaatctggaacattcatgatcgctgtaagaccaaagaggacattttggggggtaataagaaagttaaagctgccttcaaatcaaacgtgaattatgaaactcttttccaagaagcttctattagtggcctcatcagctatgtttcaagaaaggaagttgaaaaaaaatcccacaacatggaatgcgtatttgccatgctcttagaaaaatggtttccttgcgaagactcctttgtctctacatacctggacctgaagaccttggtgttgttttataaccctggaagcctggctgtgatcatctattaaggaaggagaaggaagctgcttatctgtcctgaaagtcttatttctactcatcttctcgcctccttccacaccacctccccacctacacacacccttgccctaaattcctttccattttgtcctttcgaaaactcctccctcccttagaaaagctaaaaataatggtaatactttccagtgatcctcccttattaggatctcagatgcaagctgcaggcaaggaggaaagcctgcatggtcgctgctgctcacatctgcatggttacaaatcgtggctcactccagctctcatcttagatgttcatcctcacttgaatcccagtgccataacacgccaacgcgcctggaaaacacctgctgtctataggttgcaagcaccccacagcatcccagatgtagggtcatagactcagagaattgaatacacacccaaatcctctagctgtcattagggggagtttcacatgattgtagctacacccaggattttaagcccccaaaagttatttaggaaggattgcaggctcattcttgtgttcttaggagggtcccgacctgcggataaagacctagaggaagggggaggccttgaggcggagtcccccaagcagagccccaacttgtgtgtgatcctgcgccacaacttggccagccggcctggacagctggctctggttactgtgggaacaatgcaaggaaggccgttgtcacattcctctgaggtcaaaggcacaaccttcgtcacacactcagtccctgctggcaaagagaaagacgaggagcgtggaatcggagacctggagcatgcgagggacttgagaaattcaccaactcccttgttttactgattaggaaactgaggtgcagaggagagctatgacttgctcaggatggcacacccaggactggaattttctcttcatggtccaataccctgatgttcctctcatcatctccagtacttcagacttgatagtaaaaaaggattcttgataacattattatattttgttatgttttcccatgctgcaatcgagtctttaggttcgaagtgacaaccctgttacttttgttgcgagacccttgagtactcccaggacaaatctagccaacaaatagcatctttagtgaccctatgggaagtcattggcttctagccctaaacccagaggttagagttaatttttaagtgctcgcctttaactcaagcatgaagctctaaaagcatcaagtagtaatgcttgaaaacatctaaattcctctgagccctaggcatgcttaaactctctctctctctttttttttttttttttttttaggaaaatagctgaaatggtagtggttagaacacatgcaaacagaattactgaataaaattggtcacgtatcccctggtttaaggcatatttaggagttcaattcacatgtaattgatcattcttttttctcttggcatactttcctgtaagagtcttatgtgccctgcctttagcatatgtgcaagccgataaaggatgttcatttaaaatttttactattttaaaaatacacacagagggggaaaagacttgtcttatccccaaatgaaaagaattagaaataatacttttgcctgtaaacttctatcagttttcctgtcatgggaaagggaaccataaattactttttataaggaaagtggtggtgctagggccacatgtcccctcccgcacagaatgagaggtggtggtggctgcgggacggtgggaaggaatgagcgggacccaggccagagctcagctccctgggctttgcttgtctcgcattttgtaaactcaaatgtcccatcattcccaaaggccatttgtggacatgctgtgattttatgcatcaccttctggaaagaatgtgttccgttccctgtgaacttatccaggttgatacagtagttccccccaccccccatcttcggtgtcattttctgctgtttcaattacccacagtcaagcgtggtacaaaaacaggtgagtgccatgcaataagatattttgagagagagagagagacaccacattcacataacttttagtacagtataatgttatgattgttctattttattattagtttttgttgttaatctcttactgtgacttatttataaattaaactctatcatgggtgtatatgtataggaaaaaacatagtagatatacataaaggtactattcatggttttaggcgtccactggggtcttggaacagatcctccatggatgggaggacaactgtcttttgaatgtgtcagacacaattgtggcatttcttagtgtctttttcctactcgttagttgtatttggctgctgcaaacaccttgggctcccaagtagttgggaatgtggaaagctacatactttccctctagagagagccccagtgtgaaaaactaagatagccgtgtgtttgctgatccttgggacgagccagggaagggctccgggagcactgtgtgaattaaggctgtcaagaccaaagtaacataggagggagaagatgaaaatgcagcagcacgtctcttaatgtgatcgtttctctttccccttactgaagcatagtgctctctgctatttgaagagcgcaatttagatttatattaaggaatgaataaataggatgcggtgatgaaatctcatctggagtgaatgcagattgtggatgctaatgaccgtgtggctgtgcagagaacccattggaagcctgggcgcttctccctcctctgttcacccactaggcactcaagagcaactcaggcagtggggaaaaggttatctttttttaatgtctctcagtgttgcatcttgccttatagcgccttaaagcacttgacaagccttcaagtaattcttggtggtggcgttttcccccagaaggccttaagagatggttttaatagatacacctatcaatttattcccaacttgagcattttgctgtcttgcatcatttgacatcaccagaaagtcctttggttacttctgtagttcacattgtactttctgtcctttgagttttgggtgctcaggggcaagatgtcagaaatcctgagttttagttgtgccactgcgtagctttgaccaagtcactttacgttagcaggatacaatttccgtgttcattaaatgaggagactggactgaaagctcttagaggcctcctctagctcagacgttctgtaacactcagggctttctgcctcctctgatttggcggtgtcaggatacaggtccaagtgcggcactgtgccttgcaaaattgctctctctccctggccagcttttccaccactgtggaatgaagtctgccgcctggaagaatcccagatttctcaaaggcgtccagttctagggagcagcgtgcaaagcccttgagcacactttgacttcttctgccctggctggtgatgaaaaaccaggtcaccagaggttgccctgtttccagtgatcagccctcgggactgaaaaaggaacaaatacagaagagctccaaagaaagaaacagaaagagacgctcaagctgggaagctaagaacaggtccctctgctggggtggaaggagaaagaatcttaatcctctgccttcccccatgggtcagagtcgtaaatgggtgagacttgaaggtgtggttggtcaccctctctcaaagtttcagggctgggtcaggtgtcctagtagtgttgcgtggtgcagtagtgagtccccagcctgcattctgcaaagccccagaggctccccataaactttgaggctgtgggctgccctcagcctctattgaccggggcagcggggcagcttctccttcagctctgtgatattctgaggctatgtaaaatagttttcttagaaaggtcctgtggttaaaaaaaattttttttaaaccactggtttagttacgatgagctcatattcaaagcaatatgaccttagacaagtcatttgattttcccaaacctcattttccttatttcaaaacaagtttagtcatatattctcagcctgtctcccacagcaatttaaggattaattagagtcagttattcataccttcactctatgaacacggtattgaacacctttcagtagaaggctctgttgggagaggaactcataagtaaatacatgagacagccattccaagcagagggaaaaagcatgtgcaaatattttgtaaactgtaaaacacaacacaaacctaacattatgtaatattgctgttcttaaccaggcagtttaatatagtgactctagagcctaactccttggctttgaatcccaactgcagccatttatcagtgtgacttcaggcactttacctaccctcttgtgcctcagtactccaatctgtacaatgggaataataatagaactcatctcactgggctgttgggagagctgaatcagttccgggcgcagtggctcatgcctgtaatcccagcactctgggaggctgaggtgggtggatcacctgaggtcaggagttcgagaccatcctggccaacatggtgaaacccgtctctactaaaaatataaaaaattagccaggcgtggtggcacgcgcctgtagtcccagctacttgggaggctgaggcaggggaatcacttgaacccaggaggcggaggttgcattgagccgagatcatgctactgcactccagcctggtgacagaacaagattccgtctccaaaaataattataataataattaagagactgacacagagtaagcactctataatgtttattattggtgatttcaccaatgcactgtgaaattctgtttcttgattctcagcattgcagtcccctgtcattgcacttccagttttctcttccccagaagatgcatcccgtgttcgagcggaaaggcaagggaaacatcatgtcaagaaaagagttccgaacagtactctgtttctgtggcatggatcctctttcctctccttttctcctttttttgaggttggattggcactcctctcagacttaaacaaaggctttgctttgcagagaggatctttctgccttcggtgtgtcatctgcctctaagggtgtaatttgtttctgatgcatgcagggtgcccccttgagaaggctttgttgatgttgtgcagaggtgtcctgtattgatcggtgatagaactgttctatagtgggtgaatgaggtaattgtcatcaggttactctagtcggtgaccttgaggctgatccgatgactaagccacagaggtggatccctggttatagaatgtccttgtttaaaggtaaatcggtgtgagagtgactaatagttttaaagaaatgatggcaagcaaatggcatgccctttggtgagagacacagtctatatcaataagctctgaggccacccatatctgggtgagatattggggctgattttcaagggttcctttatctctctgctcctctcttatctcttttcattagattccaattctccataacttccatgaccgtgtataatacagtcactgccatgactgtgtataatatcgtcagtgtgaagttcagagcaaaatacataggcctctgagctagttggctgggtttcttttttcttttttaaaaaattcagcagtggggtgggacagagctgaagatgaaaagatgcttgatacaagagaagagagaaagcaagcgtcatgataaaatctgcatgcaaaaaaacccttgttataaaatgaaaagtggaatgaatcattagctatacatttaagctggatcaacacattagccctgtgattaagagtttctaaaacctacctgccagcatccctgctgttgctgaactggtcctttctgcatgggaatgggtagaagtctaaatgaacagacttagagtgggttggcaggtgaaggatagtgggggtaagtagtgaggagaggataggttagaatagttattttgggctgggcgcagtgactcatgcctgtaatcccagcactttgggaggccgaggcaggtggatcacctgaggtcaggagttcgagaccatcctggacaacatggtgaaaccctgtctctactgaaaaaacaagaattagccaggtgtggtggctcatgcctgtagtcccagctacttgggaggctgaggcgagaggattgcttgaacctgggaggcgtaggttgcagtgagccgagatagtgccattgcactccatcctgggtgacagagcgagactatctcaatcgcaaggacaaaaaaccaaacaccccatgttctcactcataggtgggaattgaacaatgagaacacatggacacaggaaggggaacatcacacaccggggcctgttgtggggtggggggaggggggaaggatagcattaggagatatacctaatgttaaatgacaagttaatgggtgcagcacgccaacctggcacatctatacatatgtaacaaacctgcatgttgtgcacatgtaccctaaaacttaaagtataattaaaaacaaaaaaaagattaaaaaaataaaaagaacaattattttggaatcattgaataacagtcagctctttgtatgttggtcaataaaagcaaacacctataatactgctctaagtgctttgtgctatattaaccctttaatcctcacaacttttgttatgtaaattttatatctgaaaacagtgaggttaagtgatttgcccaaggtcatttaaacccagatattggctctgccccggtgcccttaacacttatagcctctcactgtcctgggtggtgaaggtcttgagggcaaagagagaaaggaaattcctattttcagtggacatatttcttgtgccggtggaaggaatttaattattacaaggggtttcatcaagtgcactaatctgggaagttgccagcaagctgacctgggtttaagtgattctcctgctttgacctcccaagtagctgagattacaggcatctgccaccatgcctggctaatttttgtatttttagtagagatggggtatcaccatgatggccaggctggtctcaaactcctgacctcaggtgatccgcccaccttggcctcccaaagtgctggtattacaggtgtgagccaccgcacctggccaagacaccttttttagcttccaaatcgaagtctgtttttgcctgtatcatggttgtatttcagttagaacatcatttctttttttttttctttttttctttttttcttttttttgagacagagtttcactcttgttgcccagactggagtgcagtggtgcagtctcggctcactgcaacctctacctcctgggttcaagcgattctcctgccccagcctgccgactagcagggattacaggcacctgccaccacgtccagctaattttgcgtctttttagtagtgacagtgtttcactgtgctgaccaagcccatcttgaactcttgacctcaggtgatccatctgccccagcctcccaaagtgctgggattacatgcgtgagccaccgcgcccggccagaacatcccaatacataggcagccacttatgcactagagtccttctcggagggtgagcagagttggctctccctgtcggtggcatcacgttggcagaatacacacacttttatcctgtggcggttggcgaggccattgatttgctgcgtagaatagcaaggaaatactctagacaggtttaacatttgttattgctaatgaatttgtcaagcatcggaattcagggacggttgatgcacacttaaaatgctctgaaatagattttaccttttataaaagataataataatctcatgtttgaatcacaagaggtacgttttccttaaatcttttaattaactcctatttcaagaaaaacctcttatcaaaaaaaaaaaaaagattttacatttcctaaggccaagtaagagttgaaggtagaatgagtaaataaccaagtttatggaaattgtaaaataaatacatgtgttataaatgtgctatttaatgaaaatgtgtattgactagagcaataatgatgtatctttgaccatgataagtaccagtgctgaaatccatccaagccacaaaaatgattggagggtccatgtggaatataaagctctgcagagtctagagctcatatcctatatggctttttgctaattaataaacattggccttttgtctattatttaatagcctaattgcattgcacattgcagtagcacattgcaatagcacattggcaaaagtgctgcctttcactgctaaggggggcagttttctgtaaaagaggttaaaaggagaaatcagaagcctaatttttgttaaatgagatgtcccccaaaagtcagatacatgcatatttgggctaaataaatctttcctgggaaactcttctatgactgggcagagttgttcacgagagactttccccccaacattttattaggaaaaattgcaaacatacaagtaaattgtaagaattgtacagtgaacacccataaacttgccacctagattttgcaaataatattttgctatatttgctttgtcaggtatcaagccatctgtccatcctgcagtccatcatgttttagttgatgcccttcaagactagttattgtgtatcattactcaatcaaaataaaatattggctttagttcttgcttttaggtaaattttattttattttattattactattattattattattgttgagacagggtctcactctgtcgcccaggttggagtgcagtggtacgatctcagctcactgcagactggaccttcggggcttaagcaatcctcccatcttagccccctgagtagctgggactacaggcataggctaccacatccagctaatttggtttttggtttttggtttttttttggtagagtcagggttttgccaggctggtgtcaaacttctgggctcaagtgatccaccctctttggccccacaaagtgctgggattacaggcgtgagccaaccatgcctggccagaaaaacccaaattgagggacagtccacaaaatgattagtctgtactccttaaaattggcagattgtcacttttatcacatcatatgtgacctatcatgggctgttgatcttgatgacctcagccgaggttgtgtcagggtttgtcaactttaaagttactctttgtacacagacacactcacacacacccttttccatactgtactactcgttggaaggaagtcactgtgcacagcccacacttaaggggtgggcagttacgctctacctttacaagggcagaacatctgcatgaattatttagaactcctttgctcaagagatgcgtgttttcttcctcttttaaaatttatttatatcaatatgaactcatgggtgtttattttattctttaggttctaatccagtactatgttgtttattttgttgctctggttgttttagttctggccattggcagctctttgagaaatattaggaatattgtctcttgtcccccttttatatgcccccatcactgtggggtattgatttatctatttagcattttcccactttctgatactacaagatgctccatgctcatcttggatattccctgtcacagtactagaatcagccatttctccaaagacccctggtttgttttattggagaatggtgttaggaactaagttctgggtgctggggcttgcagaaattttatgcccaacacatattagctccccctcttccttttgtgggagtttggtgtgtgcagtagtgagtgccctgtgaaatcttcatgctacagattgactttagtccctcactgatcctagttcacttcaggaggagcctagctcactgtggcagactagacagaaggcagcccagccagtcaactcaacagatttcatttattcagctcaatccaagtcagacttggtgctgtgcttattcctgtgggcagatgccctgccctcacagacccctgccctctagaatcaaatgacaggacagtaacagagaagtgctgtagaaaatcagaatacagaagggctggtgcgacctagcctaagagcattcaaagaaagctgtttatacaagagcagacttaggaaggtttattccagatgaggaggctagaagcaaagacatggaagtgggaacagatagtctcttaaatatctatggataagaagaaagccgaaaataatgaaggactttgcttcttgggtttattttaggtaggaagtagggtttactgatcttggtgggatgaggaaatggaccagtggtgtagtggagccagcttgcacttttatgagccaagtgttaaatgttcagaaatttggggagcatgttgacatcatgttattaccttgaaattggccatggtgggagtgtttacactacagaagtctgcaaatgctacacatcaggggtcctctctcccctcccacttttattaaacatttctgcacacaccactggcttcagctgtctaaatatctagtatgtacccttaccctgaatttatttttttttcctctagtagtctttttcaggtacacatttttatttggtgctttgaattctctaacaaaactgtcaaaaaatggttacagtagagatgtgtgcccctgattgaaaactgcattttactgcatattggttaaaactcttaacggtcagaaaattttttggttaactgggttatttgggaccctctaatggccattctcaataactgagttggaaaagtgcatgattcaaatgtactaaaccattacccagccttctactttattttggcagcatggggaaacctgttgtcacctgaaggtagtcatcagtgtcatatatatgtggtcataggatttatggttgggctggcttggaggtatcttctgattcttaccaagaatataggaaaaaacgatatcattttctttcagctgagaaaccatgactcaacgttattctgcttgtagtaggcaatgcaaccctgtatcagtttgacttttgcaaggatgatacctgagtaatccagggaatagtgctatgcaaatagggacagtttccatgaagtcacctcttgtgcatggtatatggtgttaagtgttatgccgaattagactcagagcagcttacatttcaaacgagtcacctaaaagcagttatatgcgtgacgaaggagaatggttagggaaagaagaagacttctcttactcataactggagattgtgagttttcactgtgatcctgaaagataggttggctttgccttaattacagggatttcttttacctctttgccctttcctatgtccctccatcaggtatggtaaattttcctagcttttgttcctattagtgactttactcctgatccactgccaaattgggtctctgaggttgtaaaactcagaaaaggatattgcaagcattctggccatattacaaatctcatgtgagagctcactctgaatcaaaggagctctcacattcttttttagtccaagtgattcctagatgtggaagccgatttcctggaacactcaaacgaggtcacagttcatcagctgcctcccataaaccaaccctctcaagtttcaactctcatttgaaacttcttgggatatcttgatccaaacagatcacctgaaaagctcccttataaggtcaagtgatcacaggggtcttcttcttcttcttctttttattgtgataaaattcatcatttttcccatttttaagtgtacagttcagtggcattaagtacattcacattatattgcagtcatcaccacgatccatcttcagaacgttttcatcttcccaaagcaaaactgcatatccatgttgtagcatgtgtcagaatctccttcctctttagggctgaataatattgcacatatgtatcacattttgtatctattcatccattgatggacacttaggttgcttccactttaggttattgtgaattatgtggctatgaacactggtatacaaatatctgttcaagtgcctcctttcagtttttttgggtatatacctagaagtggaattggtgaatcatgtagtattttttaaattttttgaggaaccatcatggtatttttcacagcagctgtaccattttgcatttctatcagtaatgtacacagagttccaatttgtccacatccttgccaacatttgttattttcttgttttgggggttgttttttttgttgttaatcagagccatcttaatgtgagtgaaatggtatgtcattgtggttttgatttgcattttcctaatgattagtgatgttgagtgtcttttcgtgtgcttaatggtcatttgcatattttctttgaagaaatgtcaattcaagtcctttgcccattttttaatcaaggtatttgttttttgttgttgctcaagagtcttcttgcatgcctagatagtacactacttcaagaggctatttagcatttatctggggttccatggggcagcctgttccctttgcacatatgtaatgcagagatgaatatgtagagacttaccactggaaaactgcacctggaattctcagatttgcccatatctgcttatcatggacgaggttcagtggtggatgctgcagaatataccaccgactgcttttggctactgtgtgacattgtcatctaacttttcactaagaaaaataatctctttagaggaaaggaaggaagttgagagtccatcttataatttttcagtgtaataatattctagaccaggtattgacaaactggaccatgggccaaatatcaccccagcctgtttctgtaaattaagttttattggaacaccgacatgcctgtttgtatgagtatcttcaattgctgcttttgcacgacaatgacagattgagtagttgcaatggagatgtctggcccacacagcctaaagcatttgctccctggtcctttatagaaaaagtttgccaacctttggctgttctaggtgtttaagaaatactatttttagaaccgtatatataatgtagtgatgttgactgcaagctattcactttgaaaacaataaagcttatgtagtagatattactgttttaagtatttactgaataagatagacccctgttacattactgcttttaagtatttactgaattccaattttgtgtccagagctgtgttctttgcctttgttttttgattggggcaatggctttcatgtccttagcaccactggggctgttaccagatgtgaccaaaaggtttctaacatgggtagcactttttttttttttttttttgagacacagtttcgctcttgtttcccaggctggagtgcaatggcatgatctcggctcactgcaacctccacatcccaggttcaagcaattctcctgcctcagcctcctgagtagctgagattacaggtgtctgccaccacgcccagctcatttttgtatatttagtagagacagggtttcgccatgttggccaggctggtcttgaacttctgacctcaggtgatccactggcctcggcctcccaaagtgttaggattacaggtgtgagccactgcgtcctgcctgggttgcactttttaaagtcacagaatctgaattctgcctttcctctgtgatatttcctattcgtactaaactttggtgaagtagctctgatctttagctgtggtgagaggagttatggaagagggacctgccccgaaacgtagaccacaggcaacttgctgcctggcaccctaaagatggtttcctgcttctcttcccctctatctccaggtcagagatgcagctttgctaaggcagtgattgccaatttgggaattttgagatactgtggatgtgctgattgttttgtacaaattctcttcaataccttgaccatgtatacagtaaacttatgctagctgttagaggacttattaaggtgtatggacactgtctttgaagagtttatatggtatgttttggcagttgaagagtattaagcattgacttaaaaaattatgtataataagcattgagataatgggaaagaaatgctacacatacacacacacgcatacccacccgtgaacacagacacccaggaaatcataaaacctgattgacttctatgtgtggatgttttctttttttattcatttaacttatattttaagttcagatgtacgtgtgcaggttcgttatataggtaaacttgtgtcatgggggtttgttttacagattattttgtcaccaggtactaagcctagtaaccattagttatttttcccgatcttctttgtcctcccacctccaccctccagtagattccagtgtagatgttctcttaagtaaaacgatggggtagtcgttttgtacagtccaaataagattccgacaatggatgaatctgctaagaggttaccttttgctccagatacaatatttatctaaaaggaaaatgaacccttaacccttccatggaatcgtactgcttcactaactttttgagtgaagtgatgggcattgatacagtattgaaaactttcaggcccttttctttactttttgacaatttgaccttttttcacccctgaaatatagcaatcagtatttctcttctggatctggttctacaacctacgttgattttaattactttccttgaaaaccattctcaaaatactctctgccccttacattttaagctttaatgttgaaaatagagctttggtaagagtctccttgaaaatgattttcttcagccaatatcagaggagtatttccttatttttatatttatatgttttaattccttaagaacagatatctaccaaatttcatggtatagatttataatcatcttttcaattttagacaaattttggaattcagatgttgctctttgaaatgctggtgacttctccaacttggggacattcacggactcaataagcatgccttttatttatgattctctgaggattcattcatttctgcatattttgaatgtctgctacacagagataaatgatgtaaaatccaggctatcagagctgggtcacaatttagtggagaagatgagtacgacaaaaatttaccatggagtgtgaaaagtgctcctcatagagacatgtacatcatgccatagtaagtttagggaatttggaaactcacttaagtcctaactcaatttaaattgtgttagactgtggataaatttatccgacgagaaacacataataatatgtatctactctgaggtaataaatgaaaaaagttggataaaataaaatacatctgttataaccaatggcccccagcaaggccagtgctcttgagccattattattcctgcacattctttgtgtttgggttattaacattgcgcttaggtcagatgagcgggtgttcaatctgccacactttgataactaaagtaaaatgctgatggagatcatttaagactgtctctatgctgttgattgcatgcttgtggctcataatcagaatgatgcaaagtaattgttagactgacttgccaaggctacattttgtgtcgttgccactgtcagcactttggtcccgctgtgctgcctgaagaacgcttgcctggcacctgttgggcactaatacacaactttccactgaatgtcatgggtaacttttgttctcatatcctcgcttgctatcttcacaaaaaaaaaaaaaaaacaaaaaaccctgacaaagatttttttttttttgacagagtcttgatgtgttgtccaggctggagtgcagtggcacagtctcagcttactgcaacctccacctcccaggtttaagcaattctcctgcctcagcctcccaagtagctgggattacaggcacacaccgccatgcccagctaatttctgtatttttagtagagatggggtttcaccatgttgcccaggctggtctcgaactcctgacctcaggtgatccacctccctcggcttcccaaagtgctgagattacaggtgtgagccactgtgcccggctgcaagtgcttattttttgtttgtcagaatgcttatgtattgagactttaatctctcgtgcatgttgccagggagctcatcttttctctttgaccgtgaaacccagacaaacctagctttgtcacttactggtgaccttggttaggttacttttcttgagccttattttcctcatctgtacaatgaggccaataaaacctattttacagagattttgtcaggattaaagataatagataaaaatgtgtccatacaaattagccactcagcaaatggttgtggcaaatattaaggaatttaatacttactcaggatgatacaatacaacgacaagacaacatttccaaaagttagtccgaaaatataatgataacgtaactgtggaacatgtagtatcagcacggttttactgggcaagtcatgtttaccagagacacacaattggatttggatgttaaaatctaaaccgcatggttttatggctagatctggaatacatgatatgttatgggccctcccatgtataccttcagaggatatggagctacctttggaagcaatgtatgatttagtgtttttctttttttttttttttttgagagggagtctcactctgttgcccaggttggagtgcagtggtgcgatctcagctatctgcaacctccacctcccgggttaaagagattctgctgcctcagcctcccgagtagctgggattacaggcgtgcaccaggacacctggctaatttttgtatttttagtagagacggggttttgccatgttgcccaggcttgtcttgaactcctgacctcaagtgatcttcctgccttggcctccgaaagtgctgggattacaggcatgagccacagcacccagcagatttagtcttgatggtgtaaaaaagccattgtatagcacacaacacagcctgaccatctaatgctcactcatgtaaaagcggtgaccacgagagagttgggcaaagcaaaaactctgtccctataagaagtgcattgttagatctggaaacatctcaccaggtcctgaattgtactatgaaaagagatttgttaaaagtagctcagttcatattccatgatattgcaaatgcctagagtgaattgtcaaagaaatgctctctctgactccatccactgctgacatttaaggtctgtgttcttagttcccaacattgattctatttcacatggtcaaaatgtaatagacatgttttttctaagagcatgacccccaccacaaattaccactccccttaaaaattgcatcggctggaccagggatgaagcatttagggagcatttgttgtaagggactgtcacctgccattggttatggaccttggtttcacagatcagactctgtgttgctctactttgcatctccgcctttgatctcgctgggattttgcagccagtatctatctcctttggcatttctttgctgctgctatgtgttctttctccctctgctgctctctgccagccccatctcctgcctgattcatggagcagtgttggatacttagaaaaggttaactgcattcgtgtctccatggctggagacacgatttccacacactctgcccattgcggggatatgctcacttccccagcctcccctcaaaagtgagattttcctggaatgtcactagtcgcggggggaggtatggcacccttaattgagggcaaggatgtgtcatgtgacttcagcaaatcctatcacatatatttttaccaaaccaaccattctctttgagaaggaacttagattagaaatattaacactgaatgaatattttaatttttgataccttctaaagaaatatggtaagtcctgattttttttttttttttttaggttttcaccttcaaatagtgatttaatttctaggatcactcaagatcatacagttttttcagttaactttcctctgtatcattaagtaactctaccatgattgggctgaaacaaggacatttgcttgacttcagacttagcgatttaatacttgatctagccatccctattcacccattatcccgagtctttaaaattgagtcctttttcgatatgttgaacacccactgaatattcttttttttttttttttgagatgaagttttgctcttgttgcccaggctggagtgcagtggtgcattctcgactcactgcagcttccacctcccgggttcaagtgatcctcctgcctcagcctcccgagtagctgggattacaggcacctgccaccaagcccagctaatttttgtatttttagtagagacagggtttcaccattttggccaggctggtcttgacctcctgacctcaggtaatccacccgccttggcctcccaaagtgctgggattacaggcgtgagccaccgcgtccggccacctactgaatattctaatgtgtgattctattccctgtggtatatgtgttagtttgtgttcttctatgctacacccactcaaaccaaaacaactttttgctgttaaggctttttatatttattcagcctgcctttctcaatcttgaaaaatgtagaagaaaaagaaccacatgctaccacaatatgtagtcacttcttataaacttgggacactttggtagactctgtaaattcaacaaataaatatgtattggttcattccttcaatgtaatactctttcagtcctcaaatgttatgatgttgatacatctattgatgttaaaggaggttttcaatataattaataagtaaaaaaaatgagacagcaaaatactatgaatactatcatagtacattataaatagattgtatgtatgtatatatatatatatatatatatagatttatttctatatgtatgtgtacaatatactctgtatacttgggcataggagagagtctggggtcatataaccagactgttaatagtgattattagtgggacttctgtggatttgtattacttgggtttttctatttatctaattattatacagtgaacagttttattttgttctcatttgtctcatccactttttttgactgcatagtcctgtaatttttttttaatttttaatttttttgtgggtacataggtgtgtatatgtatggggtacatgagatgttttgatacagacatgtaaaataaacacatcatgaagaatggggtatccatccactcaagcatttatccattacaacaaacactccagttatactctttattttaaaatgtacagttattattgactatagtcactctgttgtgctatcaaatagtagatcttatttattctaactactttttttgtacccattaaccatccccacctcccctccagccccctactacccttcccagcctttggtagccatcctcctactctctgtgtccatgagttcagtaggtttgatttttgaatcccacagataagtgagaacatgctaagtttgtctttctgtgcctggcttttttcacttaacataatgatctctcgttccatccatgttgttgcaaatgactggatctcattcttttttatggctgaataatattccattgtgtgtatatactatactttctttatccattcatctgttggtagacatttagattgcttccaaatcttagctattgtaaacagtgctgtaacaaacagaggaagtgcagatttttcctcaatatactgatttcctttcttttgagtatatacccagtcgtgggatttctggatcatatggcaacttgtctcatttacttgtgaggggtgaggaaaaagggaatacagtacaggtactcacattctggtaatttttgttgttgttgttgttgtttttgttttgctcttgttgcccaggctggagtacagtggcatgatcttggctcactgcaacttctgcctcccgagttcaagcaattttcctgcctcagcttcccaaatagctgggattacaggtgcatgccaccatgcccggctaattttgtatttttagtagagatggggttttaccatggtggccaggctggtcttgaactcctgacttcaggtgatccacctggcttggcctcccaaagtgctgggattataggagtgagccaccacgcccagtcacattctggcaaattattaagtcaccaaagtctctcctgtgtctttcctccattgttacagatatatgaacatgttgtgtgccaaatggtgataatgcctttttgttttattcagtctcttctgtgtaccaagcgccacactaaaaactagaaacattctatgaagtcgatattgttattgccattatacaaatgaggaaagggttcagagagtttaagtaactggaaccacacagctcctctgtgactcagctgaggctcagactgaggtctgactttgaaatcagttttcgtggtctcaagaattcgtactgtagacgtctcgtctgttgttaggatgaaaaggtcaatgcgtgtgagtggattataaagtgttgctttaaaacgaagaagatactcagagattttgccagtatctaccatttttcaatgtttgcatggctttctggcagtttttttcaattggagcataacctttgtctttgcagccccacctagcctaggatagtctgactgcatagtaagtgtcatgttaaacacttgtgggctgctctgtgggacttggaggagtgcccttcagattctgaggaactgagtctgggaatcttcctgcaggctggtgggccatcctgaaaaagctctatcctgccctggtggccggccacatgccgtccacgtcctctgatgaaaagggcgggaaagctgtggccttccacagctcatagaatgaatcccaaagatgctggaatcctgggaaacttgcccacagaacatcaggagctggaatagctttgcctcacagcctctcttaaacctgcaaaggcgtctttaaaatagtctctggagattattgttgagttggatcttgaacttagttccttgtgtggtgtagattaaatagtctgttgccgtcgctcccttatctccctttctttcaggcttcctctgtccaacattcacatcatctctgttctttcccacactttgtttggcccgtcagtatctcagacactgtggcttcctcacgggattactcagtcagcctgatatgtggcctccagcgcccctctgccaagtccacattcccatatgagcctaattacatacagatcactgcagggagtgaagctgtgggtataccattttgggaaagagcaaagtgcaggaatggggtactttggttatttattaagacttcttcacagcctggcaatgtagcaaaactccatctccgcaaataaagaaaaaacacaacattttaatccaggtgtggtggcacatgcctgtagtcccagctacttggcggctaaggcaggagtttgagtctaggagttggaggctgcagtgagctatgatggcatccccatccacggtcactgaattcccccatgagagggactttggagggaggatcccagggtctgagctcagctctgccactcacagccatgtgcacgtgagcaagtggctcagtcccctgggcctcagggtttccagctataaaatgggcacggatctatgacaaacccgggtaacaaagcaagaccctatctcaaaaaaataaaacacggctgggtacgatggctcaaacctgtaatcccaacactttgggaggctgaggtggaaggagcgcttgaggccaggagttcaagaccagcctgggcaacatagtgagaccccatctctacagaaacattacttcaaaaaaatacaaaaaaagacttcttcaataagcatcatggtgggcatggaggacatgacattttaagaaaggcacctaaaaaattgatttcttgggcaccacaatatggactccttgtcacaaggaccatacatctcatgataaatgaatcatgcctgtgattgttctctacatattgattgttcaaagctctgcttttaaaattcatatagtcagccaaataatcacgcatctattgttcttcagacatttattgtgcacctaataaaggccaaagtgctaggggctggaatttcttatcacctctaggcctgctcatttggactgatttagagaatggagttattaatttttttaaaaaatctttttttctattccagttttccaaagaaattagaccattttcttcgtgagaaagaaatcgacgtgctgttttcatagggtgagtgatcctttgaatctttcatgtatttttacccacatcaaaatattatccaattactatgatgcaccaagaaaaagtgtgtgacagcatgcactctctagttttctcctgcttggaaccaaggtatttttcctattctttgactctcctcatcactgggtcctttggagaggatggtttcccttgtagatttttctgcgatttcttttttgccgttcacatgctttgcctcgtgcgaggtcatcattgttgctattaccttgtccagctcacagaaaggaagtttctttccctcagcaactggtgcacagagatacagctgtaggcaagggggaaccatccagtttcaagtgactgtgatgtcttttgaattccatgaccaagaataacaggatatgagcaccagatgagacctgagagcttgtctggcaaaggccctatgtacagatggggcatctgaggcccagaggctcacatcacctttatggggcttcatggagagtagcagagctaggattttgatactggtgtgtttggctcctagctgcatgatgtttgccctgcacaagtctggttttggaatctgcagattctttttgaggctgtagagttataggtagtttaacttaatgtggtcttggtaatctaataatgatcacccctaaggcaagggtcaagactgatactgatagactatttgactttctcataatcctagttggctactaagtaaaggggttggcagagtgagtgcacccagaacacttctgttatggatgtcatctgagaaagcttattttcttctgcgccctttccaaaccactgcatctgcaatgccacgttgtcatgtgctgagacttggtggtacatctgctttgcagctagaagtcatggtacacctgcaggtgtgtgcagtccagctgcagacccacacacccgactcgcggttgtctgcacctgcagaagaatggctaacagggttcctatattgaagtacaaatctgaccttcatagagacttttgagaaacatttattcttttattttatttgtttatttatttactttgagacggatctccctctgtcgcccaggctggagtgcagtggcacgatctcggctcactgcaagctccgcctcccgggttcacgccattctcctgcctcagcctcctgagtagctgggactacaggtgcctgccaccatgcctggctaattttttgtatttttagtagagatgggtttcactgtgttaccaaggatggtctccatctcctgacctcgtgatccgcctcggcctcccaaagtgctgggattacaggcgtgagccaccgcgcccggccccatttattcgttttttttaaagttatgttggtttttacataagagtgcagttgtgcaataagatggagagaagttaagaatatgattctcagttagaatcccagaaggtaaacttgactgtgtgtgtggtttgtttgtttgtttgtttgtttttttagacatcctaggttaaatctggcttcaaattgtgttcatttaggttggtgaactaagtgcacttatttccaaaacatttcatctcacctagggagtggtcaaagggtagtattaagagcttgtgtttattattttatccaacttgtcagcttaatcactttgtcttcttccctaactagagtcattattgcggaacttgatcatctccttatgtacatacagacgtaattggtgtctaccaacatactgaatggaatgtagaacatagattgctgatttgtgagggatcatctgctgagttaccctaacattgatcgctcctgtccacagagctgggtctacacgagttagcattcattagaactgtgaaggtttccattttcctgtcttatctgagaaaagcccaaaaagtttattctcagagcacaccacagtacaatgtgggtcactgacacctgttgctctctggggactgtaaaggtctctttagagtcaagagattaattagactaaaagaagggggcaattaagggccttgagaaagtgaagaaatgtccatttccatgcttacatcataggattctttgggtaaagaataaactggtagagaagggtctgaggcaagaaatggtgaaggaatgaaagaaggactgcctgaacccatgtagaccacttgtggctactttggtttccttctggggtcatgagcactttgatgttgacattcaagagggcatcaaattattatccaaaatattacaagccgtaatttttttattttaccaaatgagaaaaaactaaacacagatagaagccatgagtatttttctccctaaaaagaagctcagaagctggcccccacatgcatatataccttgtaaaacgtgagtccctgggctcagtttcatggtatgcaatggggctgggtcttgggaacaatgctgctgttgtttctaagctcaaacagcactcaccatcaatggtatctctttaagggaaatccagggaaatgctcttgccagcgctgtgattttatttgctagaggccaggtggcaatgacatgcattggttccatagcaacgtgactgtgctgccagaaaacatataatgactgtgacagccagtgtatcctgggcaggatgagggcagccctgataccctcttttatttcccaccttatcctctcttgcctttcccctcctggggcctgtgatatgcggagaatgtggttttcgtaatggttactatctactcttgctattaacacttgcctcctgtctcggtccatcttggaacttgatgagagacaaggcaatgcctgtaggagtgttctgcaggcctctgaatgggtcagcagggttggcagcacctgcctgtcttagcaattgaaaggaggtggagagtctgtgcttttcatcctccctgtgtgtggcacagcggctctgtcagaatgacctggtggggagggtacttcctgggcatcgtggtcagctgctcctggctgaaatgtgtgggtagtgacatggagcaatgtgaaatccagggaaacagagtgctcatttaatatgctgcagattgaggagacacctaccagtggagcctgcaatgccaggcccagtaggactgcacagagaaatgcaatacccatttctcatcttctgggagctcttaccagagaggcagtttctaattgcagtttctctactgatgtgtggttggggctttcacatttctctaatgtttcctcatctatataatccttgatgaaagaattgtaagaactcttagttccaacggatactttttttcccctctgaactcctgaagcatttttaaaaatctttaccatccatttgacattgctcttgtatttccttttttcatatatattgctttgggggcctgagtgttttctaggtcgaggctaagcccttcaaggatacgaaacatgtatcttcttcttcctcttaaaaaaatttctctaatgctcacaactgagttctgcagatagtaaccatgacattaatatttgttcacgacaacgttatattctcactccatctcccaaggaaattgtgaggcaagtgtgtaaatatattgaaaatgttgttcagttcttcaaagaaaagataaactcaagaaattattttcctaatgtggtttttttaatgcagatataaagtcacaaggtaagaatatctaaaggcttcatatttcctcatcttcctctttctggctactgaccatagcatatacccctgggttttatactggcaccaaaatcatcctttttcccacctcactcccaatattcactgtattgaatttgtctttgggatcagacttctcagtctagcgttttggactattaagtaagagatttgagggatttttccattaagatgacagatagattaggtttgatagattaggatagtgattcctaatttggttttgaggtctgtttaggggagggaaggtttttatcttatggaaacttttatcttacaagagttctcttcccgtcccaagttctgagcccactgagaaataagacaagagtattgaggcagacgggggccagaatgcaactatgtgactgagggcaatgagctaacttgacacctgcctgttccccagtctagcctggtcgcaggccacctgcaggaaagttttgagtctacaggcacctgtctgtgtgaagagggaaggagaaagaggcccaaatccctgctaaccctgctcaaaattatatagattcaccctatccaaggagggggcataggccacgttggctttagccccagccgggttactcattccacacccttggggaagaaaaggttggagcaagaggtcagagggcataagggaaatcctcccccatagaaagctggggtggggcgtggcgtttccttcctgctctggccatatttctgctccctgcaccccatcaggcctacccgcccccagctcactcaagccttcttacctgttgttttcttcgtggcgcttgggcttctgcatccgactgctggtttattgttagtctcctctattagaattagctcagtggaagcaaaagccttgtcggtctcatggactgcatgtatcccagtatttaaaactgtgccaagcacataggaggcatttgatcaatatttgttgaatgaataaacacatagatgttgtttgatgcctctgctcacactctttaattacctggacatccctggtgccctgtcttgtctggcaagtctgtaggagctagttcagcaatcgtggtctcttcttgctctgtatgtagctcatcagttggcagtagttggcatgtgtgcatgtgtgtgctctcatgtaggtgagtgtgcatgtgtgtatctttgtatgcatgtgtgtgcacctacatacctgtatccttttgtgcatatgtatttgtatgtacttgtgttctctctctctctggctctgtaatacttcacttatttgtttacatatcttttacccttactagattgcaaatgcttgaagaactggggaacctgttaatcattcttgttcctctaatatctgccatgtagtaggtgctcagtatatgataatattagcattctaagcacttacaacatgcccagtactgctttattttaaaatttaaaataacttttatgtatcttgcatatattaacttgtgtaattctcacaacaaccttacaagatacattttaaactcgttttgtgggaaaggaaactggggacatgaagaggtcaagtggctggcccacagtctcacagctagcctgactccatagctttttttctctgctacctctcagaaactgactactgtatttgtgtgaatgaacaaatgactgaatgagaattttagaagcccagaccaaaatcattaaatagacctaaagacattagggtcaacacaaataagtaaaaatgatgagccatggttgacacagaatcaaggccatggctaagataaattcacagatgaatagctaatgccttcttgtagccattgcacttaattcctgatgatccatgcctgcatggtggtattggttaatgcaaatgaataattgttattacgtattgggaattatttcctagtgggaaaatatcaagtcatcagttatgagttaagcagctactgcttgcgaggctcacaactaaattttggggaaaatgatgagaggaaggaaaatgtgagttggagggtgaaaaggtaagccctgaaagtacaagccaaggtcactgtcttcaagaggctcttgtctcattaagtggcaaggagtgagtaaaagtgacattaaggcaattaaaagatactgagggcagtaaatataaagcctagcacaaggcattgttagacatgattcattaccaaatggtaataatagagaaaataaaagctattgtattagtcaggataggataagcttttgttgcagaaaggtcaaccctaaactttcagtagcttagcaaaataaaagtttatttctcattcatacagtgaccgctgtggatgcagtatctctccaggacaactgtcctccatgcataactccatgatgcagtctgctttgatctttttatccagccatctaggggcctctttcatgatcactggaagagagaaaaattggaaaattgcaccagcaattcaatgcttcaaagctttggcctagaagggacacttgtcacctgctatgtcctaagcatggcttttagctttttgtataactcccaacgtcccagtcctctcacacagcacacagtaggtgctcgataacgtgtagggtaaaagaatgaatgaacttaagaatgcattgtgacttgctcctgatggtgttgtagcagtaatatacctggcagcccccaaagcccaggcttggaacagtcagatctggctcaaaaatatttactaaaattaaaagagcattaataaaaataacaacatagttaacattaattagctatggtgatgggacaatcataaggacacgggcaaattaaactcaatttagcaggtggctaaacttacgctaaagccccggcctgccagacattggccttgtcttagacacatcactgtctaacagtccagagctcaactcacagttcacaagtcatctggtcccatcttgtctttctgaccttgttcctcctgaatgagatggagatcattaggcttgttaaaaattaagaagctttattaaggcaaagttaacctgtctgggatgcttccatgattccatcccaggtgtatggaccaccctataccatccccctcctgcatccgcttctctcatgctttcatctttcatctggggtcctggtgaacagaccacaattcagctccagatcaacgaagaggggcttccagacaggggccacgcatatgctgaggaaaacacagcaatctaacatgtaaagtaagtgggaagctccgtgtaggactcaacacggagaatggacagctcatagagagaaagggggagactgccttggacagggagataggggtcacaccacatgtgtcagaccaaagaatggggacccctcaaccacattcgctacgtgtgtattatgtggtgaagagaaacctgcctgcgaggaggactgagtcccagccactgacagattcccaggacacggtgcttcttgttggtttgtggtttgggggtggtagtggtagggagggaggagtggtcactgtgtaaatgggcagtgctgtggggaggggtcctgaactgggggttggcagtcactggagatttttcaacaagttggggatgtgaagaaccatgttttagtgagatgagctttacagctgtgtccatatcccgtgagatggtggagaaaaaagagactggggtcccagagggaaggcagttgcaggcgtaaggagataaggttttgagaactactgtgggcgtgttacaaagggaccgatgtggaggacactacaaagaaagagttgaacaaactgagcaactgggtattagaaacaatgaaaggaatggagtcagagataacccaatttttgagcctaggtggctaccgaaggtgtcctgtgttgtactttatggatattattattattaattattattattattattattttgagacagagcctcgctctgtcgccaggctggagtgcagtggcgtgatctcggctcactgcaacctctgcctcccgggttcaagtgattcacctgcctcagcctcccaagtagctgggattacagcctcccaccaccacgcctggctaattttttgtatttttagtagagatggggtttcaccatgttggccaggctggtctcgatctcttgacctcgtgatctgcccaccttggcctcccaaagtgccgtggatattattttaataacagtgtcatcccatgagatagagagcctgtggcagaacccagggattgcctgggacccagatatgcccacgtgagtatctgagttgccttaaccccacctcccttccttcgagccctccctccccaaggtttaggatcaaatcttaaatcagcagcaaaactgccaggctgaaatttcatctccatcctggccctctagtggagataaaatggtttgaatgtgggcgagaaagtaaaacggaatgtgtggttgctgagtctagctgttgataagagagggttcaccatccacccatgagaactgtctctctcctgctggtgtgcctcgctctcagacgcagcctccctatggctctgggacatgaggggtaatgtcttgccggttggtaaaattcttgcaagctgacagtctttttttgtttttcttttttttaagctccacaaggctactgcacattgcgttcttgctctttgtgatccaacaagagggagtcagttttgatttgggagaaaggaggaagaaagctgtttgatgggcgagaggaggcatgtattgattgcattcccgttttgctttctggggctggctggtcatgtcactcttcatagctgcctggctctagtggtagaagagagtctaatgagagacgctacggctgtgtgcagcttgcacacagcaactcttcagctccaaggaatcagagtgagctcctgagctccctgggattcagaggtgcctcagccccaaatctttttcccctgcatttaggctagaacaggaaagatgctactgggagagaagagaattcctgacatcttgcctttcttgtctgctttctgcttgggtctgtggagcagccacctctgggcagaggtgcaggaagtgtgacagaacaggaaagctttaaagtcactgtctccctccctcccatgccctaggctacccttgctggtcagaacctcctgcttactctggtggacagacacctgagttgctgctcttgatgaagtttctcccacttcttcaaaccagcaaggcataggaccccacttggcttggaagacacgtgacgctcttgatcatttcagtcccttttacatccccataatatcaccgtggcctgttagattgatttgtgagtaagattccttgcaaatagcaagatgatcggaagcctctatcttttccgggggaggtgcatatttaaacagacagcctaagctatttatagattgtaatgtattgtgttacagggaaaaggtggaagtcaacagtaatgttctgttccccatttcctatagtttcaagcatattttcttgctagtcctagagactttaaacatttagaatctccagtgatatctatattcttttgatgtactttgtgtagaaactcaagcacgagcaggcttcagagtcagctaaccaaagaatcttggggcttttgatcactttccattagcacaaacagtgatctctgccctgttgtatattgtttgaaaggacatttgctgtttaatgaagataaacatgttgctgggtttttaatatgtcttctcaactcaggagctgaaaaatgcatacatgagattagttctgttggcgtagaagggattctgcgtgccccaaacattttcctagccgttggctgaacttttgaaatgtgctttgcactgcaagaacagatactgaacagatattttacttagaaagccttctgtttcaatggtgattcccaggggccactcaaccacatcttactaaataatatttggtcaaaagagaaacgtgagtgcaagaaggacacatgatcacagccactaacaaattcctagaaagtgctgcttgttgtcatttctggttaggaggtgatggtgatggcaggtagagggtctaagccattctcctgtctctcttttaaagtacattcttctgttgctgtagctcctggcattggctgtcaccctcacttgcaggagggagggaatgactgtttgttgctgttggtgtctgaaaatctgtgggcagaacttttagaaaaagcagaccacagagcctgctatatattttgttcagcccattctatttctcttcactttttaaccgattgcgacaaaaaaaggggcctgccttctaaacttgtctttatctttaaaagagaataccttttataaatgcttagaacttggagatgctgttgtttttatttagtatttgaaaagctaagtatgctgacactgtcctgggagtgcaggcccctcattgagagagaacagtaaacacagcaatgactttgcttttaatttgaaatgcgttactcttcttagagctgaggggtgatttgagatgttcctgttttcacattcagctatttcctggttctgtgatcataataaattccatagctccaaaacattagagcaaattgtgtcttctgtaggagttatttacggatactcaaacaaatggtgctttctgaggaagaagaactgtgtatgaaaactatgtggtaaagcctttcatatctgccgtggtggcagaacttctgaggagctggctttgagggtaatgatatctttatcaccctgacgctgaatggaggcggggaggcctttgtgtgttctgttgccaactaacacctggctgcctcagggcatcctgcctggtaattgaacccatgagtatgtacaaagattagagggaccgtttgaggagaaagatgggggctggagaggcaaggttagtcttgccattataagcttaggtgcagaaggaagccaagctacctggaaggccacctcgtggcaaagacacccactaaggcagggcggtggcctgggactgaccatcaatcacttcccgctcattctcctcagaactgaggactgttgtcttcagtcttccccagcctcgcttatcttcctcctgcttcctgaaggaaatatccttttgcaatgggtggactatcaacttgaatttttagcaagcaggctggagaagtttttggaagttttggagacatggctggtcttgaattcctgggctcaagcaatcctctcactttggcttcccaaagtgctaggattacaggtatgagaagtttttggaggtttcggacttgttgctaggttgattctgagggagaaaagacctctgttattcagaaggttgtggacttctgaagaatggaaatcgggcaccctgaaggaaacatatgtcaatcctagtcctggagctagcatggctcaagtttattcccttaaatgtctattgtgttaaaacataaaaagagtttagatatacttccacatctttgcagttgttagctctctggacatttataaagggaaaggaagagtgaagcagagccccattaattcccatgcatggtgtctgctgtttgaatcctggaaatcaggatgattttattcacatgttaatgccctctagtggctagtgaggtgccctctaagcaggactttccccagcttccaccccttcctctccctaactaaattaagcacccactttacagtagttgagtatgtgtcatatcaagtctgtattttcttactaagattcatctaccacgtgggaaaaaaaaaatcaaaagctttgttacagttcaaagaacgtagtgctgttgctacatcaagtgaggataaatcttccatctgtagcaatctgtattataagtctactggatgtgacagaaaactctttaaaactttgatgcacatattttcacagccaaccgatttcattaaagtgggagaagtgtactattggcaagcagtttttctgctgacttcccacccttaaatagacaagctttataaaaagacaaaatcttcccagatctatttggttggccaaggtgacatttgtcttcctccctcagaaggttggtaaaattaaccttctgctttctgtatacctttactgtatttttatttctatttatttatttatttatgagacagggcctcactctgtcacccaggctggagtgcagtggtgcactcacagctcattgcagcctcaacctcctggggttcaagcagtcctcccaccttagcctcccaagtagcttgggactacaggtgtgtgccaccatgcccagctaatttttgtatttttggtagagatggggtttcactgtgctcctctggttggtcttgaactcctggactcaagtgattctcccacctctgcctcccacagtgctaggtataagccactgtgcctggccctagttttatataggtaaagcattagtcactcacaatgatctttgaatgagttatgtaagttatgtttggtttctcctactttgttttcctagtcagttcaaccagtcaagtatgagatgagtggctgctgtgagcttgatcaagtgggtcggaatcccctgggaatattgttaaaatgcaggttctgatcctgtcggtctgagatagggcctgagatgctgctggtcccaggaagacactttgaggaacaagttgctaggtgatgcagaagacagaagccatatttgattttcaaaaatcctatgatctgaaaaggaactaggagaagtatacaaataagtatggcataagacagaaggtgataaactgtatataaaagtaaaaacacgcttcagagggttaaagatagaagtgatcacttctgattgggaagatcaggccaatttccacagagaaggtgatttgggaatgggattttagtttgcaacagggattgcggggaggcgtgcgagggccattgagaccagagacgcagattctggaaagtgaagagtacgttctggaacaaggggccacccgtatgcctgtgatggggaaaagtgggagataacagttgggaaggtaagtggaagccatattgtagactgtcagacagtctgggatggaaactctggacttaattcaggaagcgaagaggaaccagcaacaagagattttgaaacgagaaagaagattgaaactgcagtttagaaagattcatctggcatgtatatgtaggatagacgggagtggggagtgacagcccattccaagagaaggagtagtagataggacagatagcatgattactcttagcaatggggaaaatagagactagatgcgatacagagagagaaggatcagaaggtgtccaggggctgtcagagtttcagtcctgaatggctacagaattaccataaataggacagtcagaatgagctatcgaatgcttttgaatggaaaaatgacctgaatgagtgcacaaatgtcacctccaagaggccttccttgtccatcctatctaacatagtatgccggtcttcttaccctgctttgctattttcatgacactttttactgtgacattaaaaggatggcaagaaaaacagggaggccaggtaagaaacctgtagttgacaggatagaaaatgacagtggcttgggcttgaatggtggcagtggcatcagagagaggtagctgggttcaagatacagcctgatagtatccagtatattctcgttgtgcatccagtctcagctgtttgtgtcttgcaaaactctgtacccattagacaataaattcccccttcccccttccccctccctcctggtaatcaccattctactttctgcctctatgaatttgactgctctagggacctcctatgagtagaatcacacagggtttgtccttttgtgactttttgtttagcataatgtcctcaaggtcatccatgttgtaacatgtgtcagaatttctttttttaaggctgatgaatattccactcttgtatatatcacattttgtttattcattcatctgtccataaacacttgggttgtttccaccttttggttactgtgaataatgctgctatgaatgtgggtgtacaaatttgaggttctcctttcagttcttttgggtatatacctggaaatggaattgctggatcacgtggcaattctatttttaaattttttatgaactgctgtatcgttttccacagtggctgcaccactttgcatttctaccaacagtgcacaagggttccagtttctctatgtcctcaccaacagttgttattttctggttaaaaaaatgtatttgatagtagccatcctaataggttggaggtttgagacctttttttaggggatatttcagatagacagttgagtcttcaggcctgcagctcaagaagtctgggcctgcattataccatagaagttcatatttatgccatcctttatcctttcaatgaattttttggccagtttgtctataagcatttaaggatttagagatttctattaaaccatcagatttgtgcttaaattatttaatctcaaagacattttaaataatatatacattaatttagacatactgctttcttccactttcatattatatgaaataattttacttacaacttttatctactatatcagtatcttcctcacgttttgaactacatggcaggtcatgtagtatcgttttccaaagcacatcatcttgacgttcatctactctgtgtttgatgctattaccagaaatttcatcctaagccgcaagtgcccattcctatattcgttggttacatttgttgagaccccattggccaaaaaaagacatatagccaagcccacagttaatgtgagcatggctatagggaggcatcctacattggggaccattattgtcacaatatcctaaaccatattattaagagatgtttttcttcattcttcctgtgagtgtattttgatgaactctgcaacttaaccacttactgtgttgcttttaaaagtaatctttaaaatgcttttttatttatagtgacatccagtgcttgcaactaggaaagtcatacttccaagaataattactagtcaaatttgttttcttccattaaaaaacaaaaggaaaaacagttctgttaggtggctgttatataaacatgccaaactagcatttatcaaggtagttttaaggtaatatgtcttccataaagactactttatttaagagaccaatagatacaataaactttgtaagaactcaaaaattaagggtacttaggcttttctgagggctttctttggagaaaaattaccttatattatattaccttttattcaggcatacataataattgtaaatttggctttggagacttcagtcaaagaaagagcttctatacaggaaaagcccttaaacactaatatagtgattgagcccattgctcataaatgtttgctaagaaaaatacttgtctggcgtattcaaaggtcagtctttcctagaggcatgaggaacgtttcagagttccttcggacattgcagtgctgtggctggatgatgccacttacccatctatttatccatttatttattcattaacttcaaacaccttctatagtgcagagaatttctaaataccatatattagaaaatctttattttatgagtttggctgacaagggtaggaataacaacagatattaaaccaaaaagttttgcattactgaaaaaattggacaaattcatattaaaagttcctaaccaaaaatctcacagatatgatgcagtaattgaaatccatcatattctaaggcttaaagcatgatgatctgcttctacagtgataatttgggtaagaaggacagtgttctaaaaaagcagccttaatatataacacggaggagtatatgtattttggtcaccggccatttgtctgtccatccatccatctgtccattcatccatccagctgtacatacatccctacatcctttggtttatttcagtggtgtcaactcattacatggcgttgaatgatgttatcaataatcattggcatgccctttactcccttagggtagaagagaattaggtaaaaggtagtactgaaaaaatgttttcccctcttgctgcaaagttataagcttttgtttcctaatcaggcccactagaccacattttgccagtgagcctccactgaaacaaataatgataatgttcatttcacatctttgacctgggaattgcagagtgatttaccaacattaactcatcaattctcctaacacttctgaacaagacattataatatatcattgaattcatcatgtaaatggattctgtgttttccagagaatttcaatatcctggccaccaattacatagggagtgaggagaaaaattaaaacaaaaattacccttttctgaactactgtcttgtggcctgatctccatcagaatgtcttattttctggaaattttaaaagggggaggtcagaggagacatcagctttgcttatgtaaaactattaaataaaatcatactagagaaaaatcattagaaaatgaccatttcccttaaaccactttcttcatttgactcattgcttaataaaatgatgaacttgaaacgatgctgcctgctccatgtcacccaaatgatgagtcacatcatgtgaacaaatggaaataaatcaccagcgaaaaggccaaacttctgtgctaccctagaaatattttctatttttccagggcttccaatgatcttccattcctgtttaactcagcttatagtaagccctgatgccaagattttctgagttccctgccaaaaccatgatgctctcagcctgggcctctcttctaggagggaagacactgccctccagatgaagtgaaaaggagaatcacaaaaagaggattattccttatgggaggaaatgggacacgtgctgcttattgtaacatcattcgccattcgttgggtatatggaggcttttatgagaaagcagaggtttttataactcatttactctggcaagtgaagcaacactaaaattacttaagtgtttaaaagatagacgcatagtagtttatgttctcagtcatcttattactgagaccctaatttgctttcgttaaactgtcggttctccctgagagtgctattgttatcggagcctcataaccgtgtacacgggtcagtgatggtacaatatttccggaaatttaagtcctccataagtagtcaattgcaggttgttttaaggaacaaagactgcttttccagcaagcctggcttgtgttcctattaaggccccttcttttttattgcaaggggaaatttcaaaatctcattgctgtatttaactttctattttagtaggctgccagtgcacttaaccttccatataaagcttatatgcgtttatgcgttctttcccttattaactttttaaggtttgggatgtcagcctgacctaatgatagaatatgcaaaaatagtcctgataccagcaccctgagcccacctaataagggacctttttcatactgtttacttatttctgagtaacagaaagtctgatggtttggtgctggctggttaaattcaacacatggtaagcttgcctgttagtgaagaaggttgagatttgggctgccggtatgttttcttctttcaggcaaggactgagtggcttccccatgtgtgcctaggtgtccagctgaccacagctgagagggataagcagggattgtgtccagctgagtttgggcccctcactcagtggcctacgttcctcggagggtgtgtgtaattagctgctgagtagtagaaggcagtagccatgatcccagttggaaaatagaagtagagctaaagctaaaaaaaaaaaaaaaaaggaaacaggagagctgattgcaggaggaggaggaggtgggctcttgctattttctagagcctgaaccaaccatgcaaagtagaatagcaggtgttgcagctctttcccccaggaggactcctgagcctcgtaagaaggtcagagagctggttgaatgttggtgcaggaagcacgtcaggaacagcttaacactggtttaattttcatttcccctgtgttattttacacatgaggggagtctgaggctgagcgccgtggagaggtctttgtggggagcagttcacgtcagatccaggcctggtcacctcctggcctcatcccattcacctgagtgacttgtcacccttttcaagtccttttccttctttgctttttgcttctccaagtgtgagattggcaatgtgatcattatatgaaaaacatttaaaattaaaaacgattctgtgcaaatatgaaatagataccagttttctttgatttctgtagtgtcactgatgataatatgcactgtagattaaatgattagtttctgggggtgggggtgctaccactcttttatgtaccaatcatatataaaataagtcctgagttcagaaatgttaaaatgacaaaaatcacatggttgtcatatataagctatgtgtgttgtatacaggctgtttgacacacaggccctgttctttacaaggcatgctttctggaagcccaaaccagtcccaggagtgaaagctggctcctagcaatacatgcgagtaggagtcagtgagggcttaggaaaattatccaggaaattcattttgagcagcccaaactgctagctagtagctaagctagtaggcaggagtttcattgaccacatgtctcaaccacatttaccacatttcttgctaaagatgccctaagtggggctgaaaggcacaagatatatagcaggtgggggcaagggggaagtgaagaacctgggtaccccacaccctagatcattcaattacatttttaagaattttttaaatgtacgtatgttaaaaagtttcagttttgcaaaatgaagagtttggggggtggatggtggtaatggttgtgcatcattgtgaacgtacttaatgccactgactgtatagttaaaaatgtttaagatggtacattttatatttgtgtagtttaccacaatttttagaagtatatatgtaatatatatgtatatttacataaatatttttccctagtttgatgaaagtatattgtcatgtcatccactcacccatccatctttattcattcattcaacaaatatttatgaagccactgttaggtcaacatctgtgttccaagctggaatataactatgaatacattttctgtgcttgtgttactctgaggttagtttaagtgaaagccatatgaacaataattaccagccagcgtggtgagccaaaaatgaatgtgtatgtggagttaagactgtgtccagctgtgcagagttgtggggtgtcttggcatctgtcaaagagaagatggacataaagagatcacctgccaagggacagcatggacaaagcacagggaacaaacagcatggtgcagtgtgtgcagggaacagtcagtactccattggtggtaacttgtcatgaggccaggagcaaaccatagagggtctcataggccatgttaaggagtacagactcctcagctcggtggaggtcagaccacattctccagtagcctgaggatttctcagtctcccaacctctgccctgtgaacctctgtggggctgccttcagaagtacttggtggtgatggatgaggagtaggaggaaccgataaaactagatagtgtaagtagcctcaattttatttatcttgtgtattagatttctatataagattttgtttgaaggcagagttctggcttttaaaaaacacatttgaaaatcattgctgttggcaatgaggaatcataaaaaattattatagttggtgacgattagcttagtgttttaaaaatcaatattctgcattcaaagcaataaaccttctttctccatttctgaacctcacctcacagtactttgcacatactaagcattcaatgaaatgttcagtgggaattgttttagggctatgacttagggatattttcattatactactgtcataagggtccacttaaatagaatgttgcccagtaactcaaaaggaatttgtagaaatataaactatataacttgccttttattctcacttttctttgtgtgcgattggactgtaataattattttttctgagttttcttgtctatttctgagacatcaggttttataatttgatgctttggacctggttgacaattccgattctgtatgtaggattgaactttgtgggaaatagcagttaattgtattttttaatgcttaaaatgatattctgggcaagttttgtttctttacggtctatagccagaatcctactgtttttcaatttgtttaaatgcaacagcttatacagcatatgtacatgttcagttgaagataaaggatatcattatttttagcctattacaaagaaaaccacattttctcttaaatgtcttgatataaagtaatttgaacacaatttctgcacaaatcattttcaagagattggctgtcaagtgtatttttttaagtagcactttcataagaaccaatgaaactttgcaaatttagatagattctaagcctgaaatgtggttgaagatgtcagtttttaaacagcactttgagaagtagttaacttaaaagtatagcaattcagagcatactgagaatgattttgaagagtaaagtcttgatacactgaaaagaaagttgacagattcactacaattaggagacaaggaggtacaactcccacttgtgaaaacttttctcatctaaccaacttctaatacttgcctaagaaaatcttcagcaaatccttactcctttgcagctcctaaatctattgtatagaattcttccagtttcctaatagatgctggcgaggctgtggagaaataggaatgcttttatgctgttgggggactgtaaattagttcaaccattgtggaagacagtgtggcgattcctcaaggatctagaaccagaaataccatttgacccagcaatcccgttactggttatatacccaaaggattataaatcattctgttataaagacacatgcacacatatgtttactgcagcagtatttacaatagtaaagactggaaaccaacccaaatgcccatcaatgatagactggataaagaaaatgtggtaaatatacaccatggaatactatgcagccataaaaaagaatgagctcatgtcctttacagggacatggatgaagctggaagcctcattctcagcaaactaacacaggaacagaaaaccaaacaccgcatgttctcactcatagtaggagttgaataatgagaacacatggacacagggaggggaacatcacacaccagggcctatcggtgagtggggggcaaggggagggagagaattaggacaaatacctaatgcatgaggggcttaaaacctagatgatgggttgataggtgcagcaaaccaccatggcacatgtatacctatgtaacaaacctgcatgttctgcacatgtatcccagaacttaaagtaaaatttaaaaatattttaaaaataaagaattcttccagtttccttatggcataataatggaaacagaataataacatgacaaccctcctttccttgttttaaggaaaagtaagttgttaggcctgtgaacaatggcagaactgaaatggagtcttcactcaagccttgtgtgtgattgtgtgtatgcatgtgtgcatgcgtgcatatgtgcacactcacgcacatgcacaaacctacacatttgagtgcaccagtttaaaataagagaaaaaagtgacatgaaactcacttcccaatttctaccatcattaataatacattttaccaattctgatttgttctactattgtgtcaaggctagttaatgtgccccatgcattggcagacaagatgatattatgtggaaattgtgtcttgtctattataagaacctgaatatttaagtatgggagatttttgcctgatattcttcagtcttgtcactcactactgattaagctttgtaatctatatatgggcattagatgaatccataaatgaatgaattggtagtttcctcaatgttttttttttttttttttttttatcataatgaagatatttcatgaccttttaccagtcttatcacatcttggaaagaattactacatctctgaaaaccctacccaggtaccttcttgtagttgggccatatgtttctcaattcagatatacccttgaggtccactttccttaggtggacatacacttatgtacactcacacacccacatgcatacaatatagagaaagaaaggtaaatagtaaccgacagaggtagtgcctgctattctcttcagcgagttgttatcccctcgtcccattccacaagatgggtgccacattgaagatgcaaccaaattacatgcccacactcacagtggttggcccttttgaaattactgggagattataatgatacagactgtggggttgaaacaattgtattaaaatcaattttctgccacttccaagttctgtgatctagggctgtcgcttaattaatctctcagagtttgtttcctcgtgtgtcatatgggaacaataaacttactttcacacggttgttgagaagagtgaatgataactgatacaagaaattcaagttttgttagttttaatcggacatcataagacttttaaaatcatgtaaatgtacatccctaattgcttgcaagtggtgcaaggtgacaagaggagccacctttgtgggaggagtaggtggcaacctctgatgacttcaggacagtgactctccaccttggctgcatagtagaatcacttggggagctttccaaaattctattgcctgagccataccccagaccagttaagtaaggatctctgtgggtggaacccagacattagtactttctaaatctctctgggtggtcacaatgtgtagccaagttggagaactgatgctttagggggatttaaaagtcttcactccttgcattggctgaattgatgatagccagaattctacaacctacactgtattctttttgcttaagataaacagagtcttaggtatcatgccaaaagtctattatttctcttggttatacacgatttggcatgaattagtttattaagttttctccaaagagccaatcttaatgggtgggtgtcgggcttggaaagagaacagaggtctgtggatatctgaagacaggggctgttcactagaggggcacaaacacagaggcaaatgcaacccaaagtcagcaatttcaagctactgttgcttttgaaaattagttcttgcaaaagcaccacctcaagaggtggttggcttccctgaaagctcagcatcatggctctggtgggtcatcattcatgaaaacttgctgcatctttaaaatgtgggatgaggaaaaacatttaaatagtggctgaatacagtcatagtgtaaccaaaagccagaaaattaatttttaaaataatgtatatttttaaagttttgttttttcaagagaaaagactaaaatcacttcatactcaaaatctctcttacctcttttcaacaattggtgctgagacaatggaaaaagtcacctgggacacatgccagagaaagaagttgaacccttacctcacaccatatacaaaaatgaactaaaaatggatcaataccctaaatgtaggaactgaaactataaaacttttaaatgaaaacaggagtaaatcttcatgaccatggatttggcaatagattcttagatgtgacaccaaaagcacaaacaacaaaagaaaaaaatagatgcattggacttcatcagtatcaaagcctttgtgaaccaaagggcactgtcaagaaagtcaaaagacagcccacagaatgggagaaaatatttgcaagtcagtatctcataagggtctagtttctggaatatataaagaactcttacaattcaaagagaaaaagactaacaacccagtttaaagatggacaaaggcattggatagagatttctccaaagaagatatataaatagccaataagcttatgaaaagatgtccaacatcattagtgtttaggggaatgcaaatcaaaaccacaatgagataccactttattatggtcacccattatgatggccataatttttttaaaaaaggaaaataacaagtgttggcaagcttgtggaaaaaatggtaatcttcctacctggctggtgggaatgtagtatggtgcaatcactatagaaaacaatttggcaagtcctcaaatagctaaatacagaattaacatatgactcagtagttctgctcttaggtatacactgaagagatttgcaaacaggtattcaaacaaaaacatgtacatgaatgttcatagcagcatgattcatagtagcccaaatatggaatcatcccaaatgtccatcaactgacgaataaataacaaaatgtggtatagcctacaatagagtattattgaaccaaaacaagaatgaagtactggtacatgttacaatatgaatgagccttgaaaacattatgccaagagaaagcagccagacacaaaaggccacatattgtatgattcagtttatacacaacatccagaatagacaactccttagagtcagaaagtagattagtctttgccaggggctgagaggagtgggggacagggagtgactgtttcatggataagggggatgatgacaatcttctggaattagatagtgatgatggttgttcaacatgtggatggagtaaaagccactgacttacacactttaaaaacagttaaaatgctgaattttgttttatgtgaattttatcttcattaaaaaatacccctttgaccccatctcttctctaatcctgcacatatagccttaaaccagtcattttaccctttgtgattccattttcatcttattctgttttttcctctaatgttcaacttctgcaaagagacatctacactggtcttcatttcctttccagcccttccattcatcactccagattctacacctgacctggaaaggtctgtgttaactcaaacagaagcttgggcacctcttccttactagaagggcattccagtgattgacattagaaatcaagttcccagcatggccctgccaccaggctggactcgtccattgcactgtcaccaaggaatgttaagtcttggaaacagatggaggaacttgcacggcgtttcccagcaggcacaggcgattcctgcaaacttaggagagtgaaagtcacacgaacaagaatgtaaatttgtgtgagaagacgtgatgctgttactagcagagttaaagtgcttttaactttggataatggatagtctgctctgattgcctcgaaggtggatctccaagcccacagaacggtctaaaagtggaaggaagctgtattaatcatttatttaattttctttctttctctctttttctgctggggtcagcaggaatgggaatcttttttttttttctttttacatcagtcttattatgattatgattatactgaaagacctggatgggaggaatgctgcaatctgaattaaaaatagcattttctgtcctcccacacacaacacttgagtgctctgaatgccttttataaatgcagactttctgcctggctagataaaagaagctgtcacttcatttccataacgaagtcattcccgggagaattccattgttttagcaatagaatttttgtaaaaggcctcttattttgcctgaaaaaggtaacaaaaatgaacttttgagagcttattcgacaaaacaattaagcagtgaagagagattttctccttttttgatatattaggagttgtaagtgtgagaatcccctgagccatgatactaggataaacccctaaatctgcaagatgaaggaggaggggagaaatcctgttattctttctcctaatagaaatggggatatgctcttccccgagaatatgtgtcctagagccaagtgacacatagatgatgctaattctaaagagttttaaatatttagtcttaaagagaggtaggaaacttgtagaatgctcatggtgtaaagaaattccttggggtttttaatgaaacgcgatcatcaggtattttaactgagtttcaggactcttaagacaaaccacggctgcatcttgccagcgtcctttactcataaaatagtagttgatatttttctttatttgcattgaaattgcagcaagtggagtacagggtccttcatgatgcagtgtgacctgtagcgagctcagacaggcctgtggacatgtggtcacactcagcacccctctcctgtgtttccccatccctccacacgatggatctgtgctccaaatatggtatcaaatcttcagcgccacattcatagaaagaaagaataattgtatttcttgttacttacccggccctgcgtaacccacatcaaagtatacctgtctttggtgtttcaacaggtaatccctagatataatgccaagtggcatttctgctacatggtattcacagttaagaccattgaaatcccagttttaagctagaatgcttttatgaagcctcctccaaaaaaagagaagttttcaatagcacctttgtcttgcaatactttgttctgattgagtcagaaaattgtaatatttaaacaaggaggcagttactcggaatagtattaaaaaaggagtttaaagtatggagttgttgtatctgttggcttttaatttagtaaaacaagtagaccaaaaagaaaatgagtgctgttgacgtaatattattatggaaagttctgtgggggcaaacattatgcaaaagtagttaaatctggcactgattttgaatttcagaaaataattctgttgtttttgagctttgaatggcttttactaatataccaataataactttttttttttttttgagagagagagagagagtctcactctgtcacccaggctagagtgcagtggcatgatctcggctcactgcaacctccgcttcctgggttcaagtgattctcctgcctcagcctcgtgagtagctgggactacaggcgcctgccaccatacctggctcatttttgtatttttagtagagacagggtttcaccatgttggccaggctggtcttgaactcctgacctcaaatgatccacctgccttggcctcccaaagtacagggattataggcgtaagccaccacgcctagccccaatactaattttttaaagcatgatttgatgtcccagctgtagccatgcaattttgcatggtagtagttcataaaaagaaaaggaagttgtggctttgataggatgcttccaaggtcgtgtttttaatacttttggtaaattctgttacttgtgtctgttcaaaaggacagaggttgggagatgcatatgtggattctgtctcttcattttatcttcactccccgtttggtactttgtgaagtcaggccaaataaaatagttgaagatactatcatataactctcaatattatggcaaaaagagaatgagaggaaaatatttagctatttcttttttaggatttttactaattgtgttattaaaaaggagcaaatagagcaggaactgaaacagacttaaagtcagaggactggactgcacacattagcatcttgcagaccttagctgctcatgatttataaatgcttcagaaattatcaaagcatgaggcacaggctgtgtttcagccttccccattttcaccaagcacttctgcaacacctaaacactgaccttttcaagcaggcatgaataaaactctcctctgggcagaaggtgcgtgatgactcatggcaaccagaaaggggatgtgtaactcgggatgtggagtctctgggcttctagacccagacctccctgtcttctggcccactgttctttctgttgtgctacagcaatacctgaaggacctgcgtgttgaacaaataaggccaggaataagttgtcaataggagcacatgacatcttgtctttaaaatactaatttcctgagacgtcgttctacagctgctcagcacagattgggtatttatcatctatatgttcaacttacattttattttcattttattcttgatatgcagacatacttttctccaatgtataattatatttcatagcaaactttgcactacgtccataaggagatgtaacctgcatacaaatacacacagcagcagtctctgtatgaataaatccttacctttatgtgataagccatgctaatgataagaagcagtgacatggatcaacatgaaatataatttttttaaaaaacctttgaggatagacatttttccagcatatttatctctgataatgtgttctttaggccggtactaattttggattttattccttgaacacaaaccagttaatatacacagagaatattctgagtgcatgctaggtatccaaggactgccagtttgtaagaaattttacaatggataactcccataaatgatcaaatgttgactgaacagggaacgcatgatattgtgaataaatcatattcttcagaataccttgagttttggcctacctcccacgctgacctccctccaactcttcttgaggtctaactggactctcagtccagccctgcactggagatgcctctcagtccagccctgcactggagatgcctctcagtccagccctgcactggagatgcctctccatgggaaaggggtgtttttggcccagtttgcctgccacttaagctccttggtgggcagggtggagacagggctctgcaccctgctgggctgagtgtgctcattcagaggaagcatttctgaactctgcaattgccagcagccctggcagcttctctttattcctcagaaaggaaatacaaagagttacctttagttctgagttggaaaaagaggctgttgtggaacatttcattgagggactgcacagtttccttagagacttatgtgatgatttttctccaagtcacccaaaagggtgttcttccatttgaacacctgtcctcttccatggaggacagagactcaaagacatataacgtcttcaagtataatgtaatataataccatgttatcaatcagttaatcaacaaatattgatcaaagagttatcatttgcgaaagccccgtgaagcttacaaaaagaagacagacataaaccctacctttacggaagttaccacattccacttggggagatgacacctattgtaggataaggaataaaatggttagtaacataaggaaaatgaattttaaaaccataggcattcacatgcaaaaacaaaacaaccaaaaaaaaaaaaaaaaaaacttctgattgagaaagttgtagaataagaggataaaagagttgtagaaaaagtgggatttgagctggtcttgggaggtctggcttacattttgacacgtggagtagaaatgcgggctctcagagaggaagtgagaagctcactgtggctgcttcagtgtgcatgaggggagaagtagaaatgaagttggaaaagcatgctggggccagattgtgaagatcttcagcatcaaataaagaatttcgaagatgttcagtaagctgtaggaaccaatgaaggtatggatggcacggggaagttgtgttatatctactttaggaagttcgatccaacagggatgactcaaatggtttagagagagaaagcattgacaagaagaccaatgagcaggctgctgtgagaggaattcagtctgagctagcatggggcggtgaagatagaaagggtgcagaattggtaggacttggaaaccgatggaatgtgggagaaagagtagaagatgatgatgctgtcagcttccatcagaaattaaagaggaggagctgggtttggagcaagggactgggaaagtttgaaataaacataatttgtttccactgcatatatccaggagtttgtagggggagataccagggaccaggatacagatttaagaacgataaacagtagaaggaaatcattatagaaagtgaatagaactgagcagatagccttaggaaatctgtcccctagagttagaaagaacagagagagcaaaaaactgcagaggggccataaggagtaatataaggaacccaagaaagtaccatctcagagaaattaagaatatttgtttattttggttacaatagacaaattaaactcaaagtgattcaagcaaaaaaaaaaagaaatgtattgtattatatgtggattggttttctattgctgtatgacaaactacaaatatagtgacttaaacaacacctatttatttttttttgtgtgtgcatcttttctttttttattttttatgttattattattatactttaggttttagggtacatgtgcacaatgtgcaggttagttacatatgtatacatgtgccatgctggtgtgctgcacccattaactcgtcatctagcattaggtatatctcctaatgctatccctccccgctccccccaccccactacagtccccagagtgtgatgttccccttcctgtgtccatgtgttctcattgttcaattcccacctataacaatacctatttattatctcacagtttctggaggtgcgaagtccaggcatggcttagttgaattatctgttggaggtccgaagtccaggcatggcttagctgaattatctgttcagggtttcataagactgaaattgaggtgtcaacagggctgccttattatctggagctcatggtcctttttcaagctcacatggttttttgtatttagtttcttgtggtcgtaggaccaaggtcccgttccattgctggctgtgagctgggggccactctcaggtcctggcattcaccttcagttccttgccatatgacttgcctcctccatcaacatgtcctctctcactttgaatctcattcctggtaaagccccatcccttttagggttctcttaattagatcaggctcaccaagataatctctctattttaaggttggttgactttggacctcacttatatttgcaaaatcccttcacaacagcagaaccttgattactgtcccactgactaactgggaagaggtgtgtgtctggcaggggacatggcaatcttgtgggctacgttagaatttggtctatcataatataactaaaaattccagggatcaggccgggcgccatggctcacacctgtaatcccggcactttgggaggctgaggcaggtggatcacttgaggccaggagttcaagaccagcctgtcttgaacatggccaacatggtgaaaccctgtctctactaaaaataccaaaaattagccgggcgtagtggctggtgcctgcagtcccagctactcaggaggctgagacaggagaattgcttgaacctgggaggcagaggttgcagtgagctgagattgcgccattgcactccagcctgggcaacaagagcgaaaccttgtatcaaaaaaaaaaaaaaaaaaaaaaaataataataataataataattagccaggtgtggtggcatatgcctataatcccagctactcgggaggctgagtcaggagtattgcttgaactcggagtcagaggttgcagtgagtgagaccgtgccactgctctgtctgggtgatggagcaagacttcgtctcaaaaaaaaaaaaaaaaaaaaaaaaatccagggatccgtctaacttctggcatggctaaatccaagggactttactgtcatcaggactcagattttctgtctttcagcttttctctgtactgggaagcttccttctccagtgggctttctgtaagaggtggctaaagaaaccagctgttagtagcatcatgctcccgtggtctcactaggaaagagtgtgttgctcctcttagttccaggtagtctgagagaggcctttgattggcttgccttgggtacatgcctacccctaggccagtcactgtggctggagggttgttgtattacgattgcccagacctgggtcatatgtccatcttccaggccaatgtgtgaagtcatcccagcccagataacagccaaggggagagatcattccagaaaagatgctgttcaggcaaaaatgctagtctactaaataaaaggaaaagaaaatggaaggaactattactagtgaactgtatcagacattgttagagaagttaagaggaggactcagcaaaggtcactgcatttagaaggcaggaaaccattcttgacctttggaggagaaggaaggttactaacacagagaaaagtggtggaaatcaagctccagagttttaagatgtaggcggtgaaatactggcattgaatgtatagtacaactgtttgttggtaaacagaagagagaggacagccatttgggactgtattagggtatggataaattcttttaggaatagcagtgactgagtatgcttggagtgtgagaaatttccagtagagaggaaaaagactgaagggaagttgggagcagagttgaccccagcaggatctggaaccagtaggaggagaatggattcagactccaagtagagaggccacacacagtgtaataacctgggtaatatagtgtgtgaagttttttgttgtttggtttttggtttttttttttttttttggtcatttgtcgcttctttgaaatagacaggtatcattgctttcaatgtagctatcaaatggtgattaaatgtactcaaaagatcctcagcatctctctggccctgtaattgacagaaacatttaaccttagagaagtggttctcaaagtctggtccctggaccagcagtatcagcatcacctgggaacttgtcagaaatacaaattatctgaccccaccccaagcctactgaatcagaaattctacagatgggtcttagcattctctgatttaacaagaccctctagccatttctattcgtttctttcctttttttgagtcggagtcttgttctttcgcccaggctggggtacagtggcgtgatcatagtgcattgcagccttgaactcctgagctcaagccaccttcctgcctcagcctcccaaagtgctgggattacaggtgtgagccactgcacctggccttctccagccatttctgatgctgcttcaagtttgaatatcactgcctcagaggtctgcatctcccctccacatgccatgaaggtttccttaatagtggctttgagaagctatgagagctagtgatgtaagctgctggtgatgaggaaatgggggagtttgtaaatcttgaaaggagatgacaactgttcaaattccactaatgacttaagatgtaatggattggaagaacagaatagaaaggctaagttgtaatttaattttttttgagtttgtggagggctgacacatgatgatgataggcatcatcagactttcaagtccctggaagacagagaaaggtgaaatgggcttaaagcatagctgtagactggtgattcttttggagtaagggttaagtcctagaacaggttttggatatggatcatttaagttaaatccaggctcttccactagatgctgttaggaggttgcaaaagaagggcatggcaaggtttctttcatcagagagcttagaaactttttgagccttcaagacttaaataaatccagtggagtataaaaagacagtataacaaagtgctgaactgaaaaggaccttgggtcagaatgtgtggtagagactgtaagtgctgtgggcagtcaggggaaggagaaattggcattgtgtcattttctcctctaggcagaggatgaaactgacagcctggcgtaatttcccaggtccgatggcaagatattggacaccttggcttcaggaagtgctttttcttgttctctctctcctttctgagtgtgtcaaagttgccaggtcaaagtgaaggtttatactctgagactttgaatgtggaatattgttaatatttttgtttgtataagaagcttgtaggataaattacattttatcttggacattttaaatggaaagagactcaaatagaagtttggcatatttgtttcagacaggctttcagacttactccattcatggggagaacatgaatgagcctgttggatgatgctttaatgttgtaggatgaagaaagcaaactactgattttccttagtggaagaattaagttgagccagatgtgggatgatagggaagaagaaaacacttcagatgaacatgacatttccactgcttttaatttctttgcaccttgcttgcggctcatgtgggtaagtaaacagaccactgaaccaagaaccaagagagaaggttgacggaacactgttaacggtgggcataaaagctgtttaagtccaagagagaaatagtaaaaataccgtaatcatcaaggggaagccagaaatctggtacctgatccaaggtcctaaagatgtttttcagaagtctacaagtaatgtgatctgttttcagtcctttttgggggagggttttcttaacttcagctgtggcatgcaggtgtcaacaagagagcttccttttacttcactgtgataacggagtgacttggggtgcattagagagcagggtcattatttgctgtcacatcaagaataatacctgcatcaggggtgttcctctcaccgaaattaatcacagagaaggtgtgtgttgctctgatggcctagcagtcagaaagatgaatcatctcttatttcaaggtatggagaacagttgtgtcactcatttctttttcaaggagactcagttgaaatggcaaaataaaaaagagagaaataacagaacacagttgtacatcactagatcagttcgtataatacagactgtttcctctacctggaaacctgatgcctggctaacttctgctcatttttgactttcctgttcgaatgttagttttgtaagagaagccttcctgagaccctccttctaagtgaggtacccccatcatgactacaaatcacaatgttcatttttccttcatattgcctatccagttttcaaattttatgcatctcctaaaactcatataattatttaattctgtccctcttgaggcagtgagctccttgggtgcagggtcctgggctattttgtttaccatgtattccccagttgaacacagagcctggtggatttagcaagtaccaagtaaaattgtatcaagcgaatgatttaattaatgagaaagcacttggtaaactgtattcattatgaaagtgatggttaattatgtgagtagcagacacctcctttctctcttctgtcccaattttgtctctccattttttattagttctttattttgagatatacttgtcagtgtgttaccaattccaaatctaagatttgttattattcattcttgcctttttttagagataaaggaccactcttttttgttttttttcctcagaaatgctattaatgacacccacaatgctaatactacaactgttttttctgtgcatgctcatgatttgaaaggaaaaacatgactggcctttgtcgatgatgtatttgggaagcaacaagattctagtgtagcacttaaattctgtttcttgtcatcctcaaagctgctaatacaagttcctttgcctcaagtgtgcttctcaaaagtatacaaggcgaaataagttgatagtatcgttccaggagaagctgttcctgggtcagccttgaaagggggaaaaaaatcaagaaatccaggtgtggaaaatattaatgatcaggatatgaataagtcttttcattaaaagcaacagcaaataaacaaaaagttatccaatccttttccagcagggcctcgctgtgccactctggtgggtgtaagtgttgtcttcggtgggcggaaatggcagacagccaagtggaaaatttcacagtgtcgcaaacattcagtgcacgaaacgctgcaaaccagcaatctgagggagccgtgtaccaaataaccacgctcctgcatgtgccctactgcccaccttacactctttctcctagcttcctgcgtgatgccttcactttctttttcccggagattccagattcttcgtttctgttcctattctttcctgaaactcagcacagtagggcatgcagacgtttggatgctcccgggatagttgatgattggtgccttaccagtgctggcttttgtattctggctccagagctcaggaacaggcttatgaccaccaacaacgctttgcattaacatagtggatttcttctcgggaactgtgtgtgctttgcaagaatgatcttcttgatcttctccatgacccagtaagatatgacagtggcagaaggtgctagtccttgcctccttttgcagaagagtaaagccaagtggcctgttttgaggcttttgcaagtttgcatctcagctaagattgtgtctgaagtctcccagaaatggcttcaactttggggtgaggagaggctggctgtaccatgttgtgttctttttgggaaaagagcaagaacattgaacttcttttttaagaaaatggtctttggtgaactatcaattcgtctaattggtcgtgagactgtatttgttcagataacaagtgatttgatgatgtgtttacctttttctttttcttctgttctatttccatgctaggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttgtaagttaacaaccaagaacaatatgtgtagtggcttgccttgtaggattcatgaatcacttgatgtaaccgagccaggtgttgaaggggtattagcatgagctctaggtgatcgtccaattaatttctttttttaattggaagggaatttaattttttaagggaagaggtcctgtttgtatttgctggaacttgcctttctctcggcttctatggcatgctgcaaactatctacttcaggaataaaaggatggaatacagtgattctttcattgtaggaacaccttttctactggtacagtcaaatagtatcagatttagagcagcccctttaaactgggctgttgcagttcttttaggttggtgagtagggggtaaaattctccaggctaaggattagcaatcagagtttccatccagcaattattcttctgtatgtgcagttgatgaaaatgacatttttctctctggcttgtaaaatcttgaggtatgcaagttacaagcagttatgtttggtgcttcccttacttaaaatgagctgatttactggttttgatcagttactggcttgggattttgagattagtaaagtttgttcccacatgtcacctgatggccgccttgcatgagaagttttagtgtcaggtaatggaagagatgacatagtgtgacttcagggagcccttccactaggaaataatgcaaaggtgctcagccctcctactttctagagaatttaccttgttgctggactgtgtcacaaaacacagttaggagattttgaccaggaaagaaaatagctacatgaaacccaggatggcctatgaatacctctgaggacgagaagatattatcttcaaattttaggaaatgacaagccaatttcttctaggtttttgttgttgtttttgtgtatatataaatacatatatttctgtaatatatatgtatactcttgtttatgtatgtgtgtgcgtgtacacacacacacacacacacacacacacacacacacacacacacatatatatttaggtttccagcttcttaactcagccagaaaacttttttgaacatgtattacctattttttttgcagttgcctacaagatttgtaaagagcaaagtgtagcatatatcagggagaaaagtattgacaaggaaaaaaaatgttcctaatttttttggtttcatagatttctaaacatttgtattaaaatatgcatatgtatccatatcatctcctcagggttaaataatcagtaatattaatatgagcttattaaattcaaattttcccagtgcttcattgaaagcagacagtgggagacactgaagcttcattgtgtttccattctgtacacgttgggtctagtggaaatcagtcagcctggaatcagctgacctgaatcctattcctactgttgagatcaagtacactggcaaccttgggcaagtcgcgagcccccataaaacaatattttgcaagtctgtgtattgcttcatactaccttattttcatttttttctttttaattgaggtggtgccttactctgtcacccaggctggagtgcaatggcaagatctcgattcactgcaacctctgcctcccaagctcaagtgaccctcccacctcagccttcagagtagctgggaccacaggtgcacaccaccatgcctggctaattttttgtatttttggtagagacagagtttcaccatgttgctcaggctggtcttgaactactgagctcaagtgatcctcccgcctctgcttcccaaaatgttttgattacaggcatgagccaccatccccagcccatactacctttttattaagcaatcagcatcttggtttagggtcctcataaggggaagagcattgtgaaagcactattttacttatttttttaaaaaaaaccttattgtaaaagtttctgtcactatcaaggaataattgtgggccatgttagatttgggtactccagttacagtgtgttttactagaaatcattttcccaatcaggtaactgttagaatgcacttctggtggtattttttaaagcatttttatcctaggaaacaagtgtcttatgtaaaactgctttaggtttcaggctctatttaaataactcatgcagttaccataatcaagatagcttttgtttcaaatctagtgggggttttttgttgttgttttaaccgttgctttgaactgttcatgtgacaccctgtcagacctcaaagattgagtgaggttttcaaaggacttctgaagtgtacactttaagatgccacatggcagacttgaagtaattttaaaatccttctgtaaatggagtgtgttgagagagcaaggaaataccaaattctagtgaactctttgtgcatgctaagtactttcttttcaaaaccgcatttgcttggtaggggcagtggggggttcctagttttcttagtaaactgtgatgttggtaacctttcattatctgggcacatgtttacaacactggttttctgtcttcctgggtttagtgtcctgcatgccccaaagcctgtgccatggagaactgttgcagtagagaaggcaggcaattttcaaagaatgcatgtttgcacataaacagggtctaggagtgggtgtataaatgtgtgagtgataatcacagcagccattggaagtagtggttcccatgctcagcagtccttgcagatgttactcctggcattcattcctgtgcatgtcccattaactgcctctcaaatctgccaccacttgccagcagatggcctttgcccctgaagatgtttcagactggctgtaagggctggggggaggggggatcttgtacaagaagagaatgatgctgacactgaactcagagttagcagacctggattttatgcacaatgctgttgttagccatataaccttgggtcctctctaccatggggactcattttatgatggacaacttgagaaaattgagttaaatcacctccagtggtggtttttaccctaagtgtctcaagttgcataaagtatcagccttagatgaggccaattgaacgtttattttaccttcttgggttcctaaaaatcaatgatttggcactacctcatttacaactgtttttaaaacattgagcacagtcttagggttaaaagaaaaaaagagttattacatctttcactaccatgaaaccctttccacaagaccctcctgggcaccatatgacaattcaaaggtatttatttgagactgtccttagactatagctttagctgtttaaatttagggtccacactcattggtccttttgaaaataaacaggaacgatttttgaacttgagttttctaaaaccacctctgtgctcaaatattggttagagtctaagcaaggagaaagtgatccatatttcattcctaagcttctctgcttccttaagtaggaattcttgagttaccttatcaaagcagccttccctgatctacataaaatagcatccaccccatccctctcagtcctctagccttctgtgtttttcttttaagcaccttacatattatatatttatttgttaatcatcagtctcctcaactagtctgcaagctctgcaaaaggagggatggtattcttatccttattctcattcttattcttccctggtgaatgaatagtacctaaaatactgcttgttcccataatgggcagtcagtaaatattcattgagtgaatgcctaaatgacattcactaagtgaatgcctctcatgtgtgggcctgagccattaggaaaaggaacatacatgctgttctgatgagaatgcttgaatctgatagcagtttaagggtgtggggaagggatggagagtctagactattttccttagaagtggatacttgatgtgtataaagaaatgtgaggagggaacaatttgtgtaaaaaaaaaaaaattctagacctatcagtagagtttggggattttctaatactttttttaaaagtctgcactgtctgtatttcctctccttttccatttgagtggtttgctttgtcacttgtttgtgagcatcctgccctggctttctgtgaacggcggtggttttgtctcttatcatcacatcatttcatcactgcttacgttcatatttcttttcaaagtagggatgggcctgaagtgctgtatctccctagaaaggggctgactgaataacacttcattctagtgcacaccttagaatgaaaaaatggtgtgctggtacaaatgaaacccatttaatgtctctgtggtgtgtgatgggaagttcacaaaagctttcttagggaggcattgtgctagttagcttttgaggacagcaataataaaggtttctggaattttgtgtgtctatggactcccttttcagaataactgctctgagtgcaggcattactttattcctaggaagaaatggagagactaaaataaatacctctgtacctgtgtaaacagcattatgctgtctgtgtaagtcttaaaaaatgggagctgaatttctcttactctgaatctccagactaagagaattgcacacacacgcacactctaataagagcaatctgggaatttccctctgtgtctgtcagtttgtaccttttagatttgccatctgtgataccaaattctccagcgttacaaaaaaaaaatctgaagtagataagagggtcaggagagaaggggagattccaccacttttggacaagtgagggagaacaatctcctttttcttaaatccttgcttgtaatgctcctgcagattgacctacagattgtaaaggcagagaggttatgactgagctcattccatccaagtgcactggggatagcttcaagtcttctagagttttctctttcacccatttctctctcttcctcagacttccttgaatggcttctgattgacagcttcactagttcctggccattgcccctggtgtgttatttgggatgggcacctttggcagggtctttgcaggagtcactgcttctaagaagtggtgtcagagctacctcctgaggcaactgacaaagcgtagcccatcccaggcacaccctttcccctcagcaccttcttcctcaagtactcagctcctcctctcagcatcttggagaggaggaggaaaatgcaaagaacacccagacgttgtggaaggaaaaaagttcatggatcttttacaacatttgtgttctatggggtgaaacaacatcaacagcctggtcaggctgctttgtaactgaatagtgccaaggtaaaatgcttttgtgtcctctttaagtttagagttcactcaattacatgatatttattaaaagagtgttgtgtgccaggatgttcttgagtctatcagggatccagggctgagtaatctgtacttactgccctttgagactctaggaaggtgctatgggaaggatgtacttggtggcggagtcaggtgtaccgaaagggacgatgggtaagagttgtcagcgctggaatttcagggaagacatctaaattgagccttcaagcagaggtggaatttcaacccaatatatatgtgtatttagagaagacaaaggatgctttgagaagagactaggaatagtattttatgtactacttctgtgtctgggcatgtgagagctcagagccagagctttccttccatcagaaattgtttggtttgaacactgacaaaaacatagcatgaggatttgtagcacatggccaccaggccaccattttcttcaggatcattttagatatttttttttttttttttttttttgcagatgaagtctcttgctgtgttgcccaggctggagggcagtggcacgatcttaactcactgcaacctccaccttctgggttcaagcgattctcctgcctcagcctcccaagtagctgggattacaggtgtgcctcacaatgcccggctaatttttgtattttttgtagagacaaggtttcaccatgttggccaggctgatctcaaactcttgagctcaagtgatctgcccacctcggcttcccaaaatgctgggattataggcatcagccactacgcctggcacattttggatctttatatgtaaaagttgaagcaagaacttgggatgcctaaagaatgatgcctcccagcattagtaagggcagtgtttccaactgaactttgtacagaaaaacccaaacaaaactaaagatgtattttttaggtggtataaattcgaagtgctcaatgttcaagaatccacaataaagaagggcagggatgactgaatagtgataagaactagttgacattgtttagtcatagaacccaaacaaaatctattggttcttaacaacacataaattactccttaggactaatgtaaacagacaaatagaaaggtaacttcattttttaattatctaaatttttcacttttgtaaaagaatcatattataccataaaaatattaaccatgtctccaacttaaattcatgttaaatttccagtggtagctatgtaataaattattgctaagtagaattgtagactgaaagaattaatccatcttctataaatcctgaagattatgttaaccttttccagacacctaaacaagtatgttacatgattcagaaaaagtcatttttgacaagtataaaatgattttgaggtgtgatagcaaattagctgtttcaaacctatgttagagaaattaagttttcagagcaatttttttttgtatttgtgcttatattcctgaaacaacttgcttaaggagagtctccttaaatggaaacataaatggtatacaaatggctatcctctatcataatcttttatttccaaaactcagacaggtttttatcatcatgctctttggactcttaaccatcttcttctacttttaaattctacttctttctcaatacatttttaaacagcatcttgtgatcatttcccagtcttgagtgcctggcactgggaggtgacctgcccacattgctgtcagaattcgctgctggacccctgcacaggtcccaggctgttggttacgtgtttcaatctgcacatcagccatcctcaccagccttcctttgtgcatctggaaataaaaatgctcttgataaaatggttttctaaagtttccattaggttgctcttcatttcatttttcctttcttcttcccaagcctttgtggcttgcatagaattgaaaaaaaaaatgtaatttctccagggctaaaatccaagactttgataggcagtcttaatgcatggggctcctacgagttgctacccgttataagcattgtaaaactcaccctgcagaacaaagagaactgggcacaaagattattctcttcttcaaccatggcaagccctagttttccggtttcctttgccttttccttctttgatctctaaaagaaggtagaagagtagaacgctattgttcagaaaggagaaagctattgcttgtccaaacagattgttttttccttctgtttggcaacctcaatggctctacctgtttctggctgtcatacttcggcttgtgaacagccttcctccctaattttcaggaaactaacaaattaaaggtgcaaatgtcaggtggttactacatatctactggctcacataattcaaaacagagtcatgcagctcctatctaaagctagttccttgccccttctcagtcactaccacatcaagcacaaatgtagatgaaagggtagtgtgtcaaggtgagagctgcccactgggtagtgttactcggtcacttgctataggggacagattagctgccaatcagtatctcatcactgtcattggcgtttataatccaggttcctagccccactggtgatctatttctgtgcctccgcagtgacgccagttgtcctagcaacgtgctggctggcacttcgttaaaggcaagtaagggagtggtggtggaagagggtggcctcgagagggtcagaagggagttggcagtcaccttgctcaaagaggattttccatttccctcatctgggcaggcctccaggaggaaaacgtcacttactaagtgtatcatgggagtgtcacttactaaggatcatggaccacatggtctttctggtacagatagaatcccacggagaataacaaatgaattaatgggtagtccaggcagaatgtggggactgccgggccaagatgttaggcgatctcaaagcatctgatggtatcagtttttcttgtgaattaggttaatgttttgcttgtttatcagcactggcatgcagagttggagacatgagtagatgtttgggaggaatcagaggtcaagggaggcagaaggaagggaaacaccatgacagtccctcttggccccttttcctgttgacaggtctggcctgaaagccatccagtgtaacgagagccttcttactgagctctggtaatttatccatgcacccagccttgaagaggaatatggctcactttgtaatcttcttaattgctctcctctcattatgccacattgaattggcactaaatgactttttctgccattttccgatttggatccaaagaacatagaaatactgtggattgtatcttaaagtccctgtccaaagtggccttgcctagatgaaatctaaaatggacagtcaagtgacattggcagagctgggggcttccctccatggccacttctctgtggaagcccctaggcaatgggtttgggtgacattttctcctgagagtgcttcgtctgtgtggccctggagatgccaagacatttttcacgaagaaagagactcaaggtgggtctttgcaaggaaatggggaacaagggagactgatgaaagggtgtccccagagcattgaagacccacagatgacaggaagtatgacgtatgcattgttgcctttcccttcacgactaaaagagtttttgtagtctcaatgaccgttgtcatttgttccactgaatgaccacactcaagtcgagataattgcatgaaactgtgtgcttatgatgggaaagacatttagggtgtaactgaccatttctagcacgttttgtatactcaacagaaggtatattcactccttctaccatagctgaaataagggctggtagtgaagatctgggactggaattgaaagaaataatttttggaaaaagaaaaactccaagggtagctgttggcactttcagagcatcccatattttcaggatgttttgtatgagataaagtaaatcagttttgtttgacagggtgtagtgtgcccagccaggtcattattttaaattgacaaaatgatttaaatgatagaagacattgtatattcctgaaacaataaatacctattaagtacattttgatacagtggagaagtacagtttttgttttttgtttttttttttggattattatataactgttaattcaacacttagtgtttaaatactcatcattctttatagtgcacaggtcataaagatagttctctcatatgaataagaaatacaactaatgtgaatggcattaaagttagaagcttcaaattcttctctgggtttgatggttgcttttttagaagaaatttggtaaagtagatgatagaccagttaggtttcatgaacttcgtgcttcatattcttttcttttcacaacctagctagatacacagtaaataactggaagcatactagagtagaaagaacccttcttcctgaataagttgtcgttgatcacaggggtaggcgttaatcaaaatattaatgactaggccaggcacagtaattccagcactttgggaagccaaggcgggtggatcacctgaggtcaggagttcaagaccagcctggccaacatggtgaaaccttatctctactaaaaatatatataaaattagctgggcatggtggtgcatgcctgtagtcccagctactcgggaggctgaggcaggagaatcacttggacccgggaggtggaggttgcagtgagccaagatcatgccactgcactccagtctgggtaacagagtgagactccatctcaaaaaaaaaaaaaaaagtaatgactaaggagaagatagggacaccttgggctctgtccagtagcaggaacctcaggctaagaagggacacctgggttctcttcccatccctgcccttttagaccagtggcaagctactctctatctgggtgcctctatttccttatcttccaaaggaagatcattatcactgccacttaacagcatcagatttaaagtattagttcatataagagactctttgaatcacatttgggttcagatttcagacctgccacccagtagctgtgtgtcctttgggaaattgcccaacttctctgagccttatttacttcatctataaagaaggtctgaccacacctaccctgatgacctgttaagagagttaaatgcgataaagtctgttaagtttttagcccagtgattgctccctaataactgtggcagccatgatgctgttatgataaatttcacacaacaaaatctatcatgatgcgttgctgaagtgaacaggtgagcagttgcaacttgctcatctctttgttgtagagacatttctgctataataggagttgtcattaactgtcattgtcattacactgacagtgaattcggttatgtattgttaagaccttctgcttccttgacatgtatatagtagaataattatgacagtgaaggtgacacatttgtcagaattatccatgtgcatatgctgagggcccttggaattttaggtgaattttatagtattagtcaaactgaaaggcacagtgagtttggaaactataatagtctcatctataaaaggagtagggagattcccaaaggctgttgatatgagtagaactctgaaaaagtaaaacattaaaatacattttgatgtggttaccgtgtctaggtggtgataggtaaaaacagtctagtctaattctttgaaatttaggatagaagaaagcctgaagatggatatctacattcttgtatcttctttcagcaaatatttacagaaagagagagagagtgtgtgtgtgtgtgtgtgtgtgtgtgtgtatgcacacacatatgctacaggctaggcacctacagtagttaaaggagctttcagtcactggggaaagaaatgagaaaacaggcaattcctttacaccatgaccagctctctcctaatggtacccacaggttgccatggatgcagaccagcatggcatcttctgggatcagggaagctttcatcctcagacttgaatgaggagtagatgttaaccagaaaacaaagtggatgtatcagttagcatatactgtgtaacaagccatcccaacagttaagggccaagaccacaatcttatgattgtgggtcacctggactattttagtctgggccagcttggctgggactggttaatccagcatggtctcactcacatagctactagaaggctggtttgcctgagagatgggtgatcttcagctgggacagcttgtctctgcttcaggtggcctctcatcctccagtagactagtctgagcttcttcactttgcaggctaagggttcccaaaagcagcaagaaagggcaagccccagtgcatgagtgcttttcaagctctgcttcaagatgcttgctaatttccctttaaccaaagcaaattacttaatttgttcagttcaaaggatggggaaactccagctctagtcacatgaggacaacatgagcaaagctcaaaggtaagagagaacatggcatgttggaagacagcaagtagtttggagtggctggagtcaggcatatgtgaagtctcatgaagaaaaagccagatcataaagtgtcttttcagtaagttctgctgaggagtttagagtttatcttgaagacaggggagtggtcattgaaagagtttaagcaggatgttgacatgatcaatgagatgtgtagagacatggttaggtggtagaagcctaaaaacactcgttagcctagacaattcaggaagtttccaaagagatgacccagggatagcataggagaagatggaaggacttgactgagaggtggctcaaagctgacgtgtactttcagaacaatgtgaccagaaaagaggttggaggcccttcaaggtagagcagaaaagacagaggctcaggtcatcagcaatatccgtatgaatctggtgggagaactccaccagtgttcctcacctcgctcctttgtgggatcctgccagactccaatgtccttgggttctaaataaacacctaccaaggggctgagtcaaagagattccagtctctggaagtgtcttcttgtcattgtcatcacccagccaaagactcttttccttccaacatgtttttccctttgacctcaaaataaacaatgtgttctaaaggctctggggcactctcaaaatgcttctctgacctcggataggaccatgcttacccattaatttccagatctgaccttttcactacacctttaagcataactctttcaaaaggcaaaaatagaaatgactgtttcatttcaccaaattcaagtcgccaagagtgagaacgtgtggttttcaccggtacgtttggggaccagtttgttgtcactgaaactgcctgatatcgggtcggagtggctgggtatttttcagtccttggggttataactcaaatgttggaagtggtatcttttataggtaaaattgagggaggggagcatcaaaatgtgtgcgatgcagataataatttgccaagttttctaatttttttcattaaaaaagaacatacagaagagtctacaagtagggcaggcagccttcattcctatgctcttttccttgagggacaccttccctaaccaaataattgaaaataaatgggaattgtgggaacagaggaagacaagaaggaaaactaaaaacccaggacctaatcttccaggggcaggcaggccacttttgtagctcagattctgaccttttctccaatcaaagagttcgaacagactgactgattggagtgctctgtcagcattaaactcaatgcagggttctgctctggcacctttaggggtggtggtttagaccctctgcgtgccatgtcttatcaccagcactgctaactgaatgggatgcattttcaaagacaggagagggtttgaaaaaccccagggcatgctcggagcctgcaggcatttgtttgctgctgagaaccatggcaagcatttttgacatttttatcagagtcttagttaaacaattatgtggaggactgataaagaagtgtgtgataggagacttcataatttaaagtgcccaaatttggtgagctttatactcatgtgaaatggaaatgaaaacatggcatgttttggaattcctgattctgcttatttgctttaatagcagatcattgcataaacactgactcattgcattctatactgaaaggaagatatggtttgctgtgttcaatctggtctggcttccagaacacagtatagaacaagtgccagaagaagggatgagctcagctttataggtgactggagagatacccaattccatgttttgtgctgtacaaacacatgaccttacatgaagttttgcataaaatattgaaacaatacatttctctttataaatatgtatgtaatctgttctagagtgtatggagtagacagtaaaaaaaaatagaatcttcttatttttggaagtggggtgaagacgcaggtgtgcatatgctgccacctgcgtgttatttcactgagttttgtcaggttcttttcttactcatctgcactttgtatgttaccttaagcgctgtaaccattctaagctgccagggacatgggtatgcaatcaaagtcaacactgtgattaaaaccacctcctgttgtttacctttttagaaattttaataatacagtcaagtctgaaagagcagaacttttctcaaagctacacacttggttgcctcttcttgattaatgcatgggggtggtcactgtaacctaaggtctgacagatggtgcggagattgatgaagttaaggcctgttaggtattccgagtgtcttataaagaaaaataggctaccttaattcaaattgttgttgctcttccaaccttctcttatgtaaactccctgtatattacaatgacagactctctctctttctgtctcacacacacacacacacacacacgcatgcatgcacacatacgcacactcctgacatgctctactgaaagctgcccagctacagagaggtgcgaatctaatccagggcacatggctgctttgcatttcactggctgtctagtgtcactctatgatataggcataaggtcatgactgtgagctatcattgtcacttatcttaatattaaaacccctctgatccaatctgtctgccttatctattacatcattcacatatctagattcttcaaacttaactactcattgcagcaaactcaggaatgccgagctctaaggcatctccatttacttcgttcatctcaatctcaaattactaaccatagttcagtttcaggatgacactgaaaattcaaaattacttcctgtgattaacttacattgtgatggttgggaattatttcgcagaagacctgttcatcttctgatgaagcccttttcaagttttgaattgtgtgtgtgtgtgtgtgtgtgtgtgtgtgttttaattgccagaagtctttcagatagcagggagattattggaatgagaaagcaaagcttgtatgaaaacttgtggcaaaaggtcatctgtgctgtgggggaaatttcaaagtaggcgcagtttgtttccagtggttcctgcctgtcctttcagtggctggtcactctctgttccctttccagacgaatctttcccctcttccaaatgcctcacatcagtctaggtaccttggttggcctgtggagaaaaacagtcttgttgagacactcacattaagctgatagagaccttggctaggataattgcatttttcaaaggctaagggttggaaggatttaatttttctcttaattattttttatagagatgaagtctcactatgttgcccaggctggactcacactccctggcctcaagtgatcctcctgtcttgacctcccaaagtgctgaaattacaagcatggcctgaatttttttaatggtgatttcagctgatcccaggggagatcttttgggtgtcatttttcaaacagattaggaagcaagcagctgtctacctaatcagtctaaactacccattctgacttctgtccaataactttccatataaaatagctaacataataataatcagataactttgcatgtaagtttcaaagctatggtatagttcaccaacataattttccagttttttttattatagtaaagtacacataacataaaatttactgtcttagccatttttaagtgtatagttgtacattcatattgatgtgaagccatctccattgtcttgtcttcacacctctttttttctggcaaaactgaatctagacccataaaatactaatgctctaccctccaccctagcccccggcagccaccattctacttgctgtctattattttgactactgtaagtggctcatataagtggaatcatgtagtatttgtccttttgtgcctggctcatttcactgagcataatgtccttcaggtctgtctgtgctatagcatgtcagaatttccttcctttttagactgaataatattctgttgtatgtgtagaccacatttagcttatccttcatctatcagtgggcacttgggttgcttccacctttagtttattgttaataatgctgctatggatatgagtgtgcaaatatctctttgaaactctttgaaaccattcatcaactctctctttttcttttttttttttttgagacagagttttgctcttgttgcccaggctggagtgcagtggtgtgatctcggctcaaaacctctgcctcccaggttcaagcaattctgttgcctcagcctcccaagtagctgggattacaggtgcccgccaccacaccaggctaattttgtatttttagtagggtcagggttttgccatgttggtcaggctggtctcaaattcctgacctcaggtgatctgcctgcctcggcctcccaaagcactgggattacaggcatgagccaccgcacccagtcttcaccaactctctttcacgtctttattagatacaagtgtttgaagaagccttgcatctacccactttgaaccttttttcatgatagaactgtaggtagactttctgcctagtagtgttatttgaagcatcctttctgctgacctctttcctgaggcctgaaatgctactaatagtagttcagtcctcaagtatcaagcaaagccatcagctagttttctattaaaatgcaaatgatcctggggcagaggccacagataagatattagcaccttggtgtgaatttgtttaattagatcctatcttagaagctttctttaaccccttgcctagttcttcactaattgctccctgataaggtcttgcattattactgcaagtatcacactgtattaaacttatttatatttttgcttctcctgatagaatagaagcttcttaagggcaagactcttgtataattgctgttggtttttcaggccctaatagaatgtcacagacaactttcaataagctactcactcattctttcatgcattcattcattcatttcactcatttattcatcaagcatttattgggtgcccacggtgtaagtgcattttaaaactctgcctttctagaaggtttggacagccaagggccagctctgttgcacagttttggcagattttagaaaccttaaaatctaacttcctgtatttttaggtgcagggacttggtccagatgagtggatcaacctctgaaatagttttctatcacagtcctaccttttttttttttctgcttctattcagaagaagcatcgatctaagtaagtttgtgttctgttcaaaagtaaggtgatgtttcaatgtatattctcaagcatctgaaaacttctctagttgctctaaatctcaatatttccaatatcagccatgtacagtttttaaatgcttgcattctcttaggacattgttaacaatctgcttagaaaggggagtgacttttgcctcttttggctaatttgctttgcattgatttgtaactgtgtacttcagtatataccagcaactcctagcccagggatagcatatactcgcttactggttccagtgactgttcattcatcccacagtggcttccctggaaacaagttactctgataacaatttgatggtacttccctttataaggtaataaccagtccgggccaggcatggtggctcacgcctgtaatcccagcactttaggaggccgaggcgggcagatcacgatgtcaggaaatcaagaccatcctgactaacacagtgaaaccccgtctctactaaaaatacaaaaaccaaattagccacgcgtggtggcatgcgcctgtagtcccagctactcaggaggctgaggcgggagaatggcgtgaacctgggaagtggagcttgcagtgagccaagatcgtgccactgcactccagcctgggcgacagagtgagactccgtctcaaaataaaataaaataaaaataaaaataataataaaaaccagtcctaaaccaaattcttactttagtctctagcctcagagtttattagttcttagtaatgttactatgaaggcaaataggagacaaattattattctggtttttattgttactgccactgcaattcctatgattattgctataattccctatttaataggtaaacaagttacaacatattcgatggtcactagatagaaatagaaatggaatgtctttaccaagagaatatccgtgttttacagagaacaggaaacaagtactaaatggaatcttcagacaatcttttggtcttcttgtaggcagtggttcagcttttttacctactaaaattttggacagggttgttaacaggcaatacagtttaaaatgaactgttttaagttttcctttctgactttttcatactcctacattaatgcaataggattgaaggctacaacaatgataattgcaatatgctgaaataatgaactacagtaaatagctatagtgaatgtatgcccatagaaaagaatggaaaacaaatggcttttgattaaaggtacttattgtaacagatttcaaggtgaaattgttagttcagaaaagatggtagatagagtctttaaaaatactgtcactgggatgcgtgttcttctataatgctccctccatcccccacccgaagaaacacacactcctccctcctctgcatgtaaagcagtagttttgacaaataaaaccaaacagtaaaacctgacactggtgattggaccgtgcgtccctctggtttgtggatgaggagcatatctccgtgatagaataaccacgcttcatgctaactcccggccacatcgctgcatcctcttcatacataatttgcatcatggggtgtttctgcatatgttgtgcattttgatgttatttttagctacaatttttaaaacaataacatttttttaaatagactaatcaagaaagcgcctccagagtcaagaaaacaagtgctggggatgtgtgggtgggggtctgtctccccgcccagggcatttccctttgctgctgttgttactactccttccattactttttgtgactttagctttttgaaatttccattcctttgttttcccttgtgcatcaggatgtggctgttgaagtcatttatgttatgcgaggctgcaccacagtcatttaatgcaaacactggcttttgtgtaaggcactgactattctaccctcagcgaggaagacgttattggaaacttgagttatgagatggaaagaacattaatcctttcattgaaaacattagtcttttacatggattctctgtaatagcttgaagagaaattaaggaaatacaaactagtaatattaaaaatctgccatgtcattattatctacctgcccatagatgttcaccaccgttagcatttgagtgtgttttcttccagaagattttctatggatatatatatatacaaataaatacatgtagctttacagaaatagaatcgtgcttgatctacttttccgaaatttcttctctcacattgcaaaagttgtgaatgtctttccatctgaattattacagattttcaaaatatttttctggctactgacttttccagtatatgaatgtaagagtgaaagttcttcgatttcaccagttggatatgcccccttttctcttttctgccaatatcaattgtactgccctcttgcgctatcctaaatatgatcagatgagaattctgaaagagaagaaatctaggaaccctacttgatagagagttatcctcttgggttccctcctgacatttaggcctttttttttttttttttttttttttttttttttgagatggggtctgactctgtcacccagactggagtgcagtggcgcaatctcggctcactgcaatctctgcccccgcctgggtacaagcgattctcctgcctcagcctccctagtagctgggattacaggcacctgccactgcgcccagctaatttttgtatttttagtagagatggggtttcactgtgttagccaggatgttctcgatctcctgaccttgtggtccacccgccttggcctcccaaagtgctgggattacaggcatgagccaccgcgcctggccacatttagtacttttaagaagttattcctcttccatctcagcttcctggacacagttcgctatgacttttcttggaaattatgcattcccttagaatccttgtattttctgtttactttccctcaaagcaaggactcatgacctcacctgtagtgggcctccccatctctcatgtctttatgtggcccggacttagcagagacacctcttggtacatcattttgattgcatcatgagctttcccagagtctggagtgactctgtctttcagatttcattttaacctcctaatcacaggctatctttgatgcacctatctttacctccagttcttctgctaaagaactggaggcttgtggctcttgtcttccggtcaaacatgatgctctgctgactactcttccccatgcattcatcccaccccagaccctgcccttgccctcatccccatctgaatcattgcatcctcctagttcttggccaaaaaactggctctcctctagcccttcaaaccttgcctgggagtcatctttatggcaccttccctgattttttgttttgttttgttttgtttttggaaatggaatttcactcttgtcacccaggctggagtgcagtggcacgatcttggctcacggcaacctccgtctcctgggttcaagcaattctcctgcctcagcctcccaagtagctgggactacagacacctgccaccatgcccagctaatttttctatttttagtagagacggggtttcaccatgttggccaggctggtctcctgccctttggtgatcaacctgccttggcctcccaaagtgctgggattacaggcatcagctaccacacccagccgttgcaccttgcctgattaattccacttggctctagctagtatctggaaggacacctgggaggaacacttcaaacagctgtcagtgcagtgttgttgttgtttttgttttttaattaataggcttttttatagaacagttttaggtttacagaaaaattgatttgaaagtacaaagagttcctatattcctagcctccccgacccctgacaaacagtgtccctactgctaacatcttgcatcttacatttgttgaaattgaactaatatggatacattattattaactaaagtctatagttcatgttagagttcattcttcctgttgtacattctgtgtttgacaaatagatgacatgtgtcctaacaactctttgtgctctgcttatttgttcctcccaatccccaaaacccctgatttttttttttttttttactatccctgtagctttgccttttccaaaatgtcataaagttggaatcatacagtatgtacccttttcacattggcttctttcatgtggcaatatgcgtgtaagtttcctctatgtctttttgtgtctggagttggttcctaccggtgggtttatggtctcgctgacttcaagaatggagctgcggaccttcatggtgagtgttacagctcttaaagatggcatggacccaaagagtgagcagtagcaaggtttattgtgaagagcaaaaggacaaagcttccacagcgtggaaggggacccaagtgggttgctgctgctggctgtggtggccagcttttattcccttatttgtccctgcccatgttccatttctgttctgtcagagtgccctttttttcaatcctccctgcgattggctacctttagaatcctgctgattgatgcattttacagagcactaattggtgcgttttacagagcacttattggtgcattttacaaagtgctgattggtgcattttacgaacctcttgtaagacaggaaagttcctgattggtgcattttacatcctcttgtaagacaggaaagttcctcaagtccctacttgacccaggaagtccagctggcctcacctctcaatcccccctctaaacaggacaccccagctgctgttgggaactgggtgatgactgctctagctacttcctgctggataggggtgaagaaggggccctgcagttgtagtgccctccagaggggaacactctaggccaaagggctggtgggtcagtccaggggtccttggtagaagttgtgagttgagctcatttggggttccatttgtaagaccatctgtagcttgatggtatcgatcctggaggaaacaaatttgacaaagaggttaaaaacacagggcccgaaggtgagtaatagcaagatggctgtcatgggacgtagaaaggggagaaaccatgttgcccaactctagaggttggtataagagtttgaaaggcattgtctgatttcagaagccttttcctgtaactgctgggcagcatcttgtactatccctgagtggttagtgtaaaaacaacagtcttctcctaagaaggtgcagagtcttcctttctcagcagtgaggaggtctaggccttggcggttttggatattcactactgccaaagagtctatttgggattgcagagtaaggatagattttgttatttcttgcaaactgtcttgagaaatcctttgagagtgtgtggtagtaggataatgaagtagataaactggctattctggttcctgtagcagtggctattcttaaccgtataagtaggggtattagttgtatggccctgtactgacggacctgagctttgaggggcactgatagggtctgatttcctgcggtaatgttaatgttgggacttaggaagactaaggtacaggtgcctgtccagttagtggggaggcagatgtaagttgaagttccacataagaatatgccttggctgggtagacagaactggttgtgtatgttaaaaaggtgtgtgagtttgttgttttcattttcccatactcctagagtacttgccaaggtagtctggtgagtggctggaaaggggtgttgggagcaaactgagtgactccctgtgctctattttcccattggagaaaaaactgttttgtatctactaggaaccattcaagagagtgattgaaagagaggatgagaaggtattccttagtggtgggggtgctgctgcagggggtccaggggtgaatagtcatacagggagtatgtttgccattacaaaacctggactgtttgttaagcagggaggaggtgatgatttttgggggccctgagaagcggacaagccatctgaatagagcggtttgggtgccttggaagttactatgatcatttggggcttgaagttggagagtgtaattacactgatgggatagtaggtgccccaggggcaggcctgataacaggttgcgttggatgcataacggggcttggaaagttaagatggtattcacggttacagggcttttcattgctcatgtaataggtgaggttggaaatgtaagagcgtaaaagctggattgcatgtaaaaaaggttgatgtgattaggatttttgtcccggcaggagctacagtatatagtcctgctgcaaagagaatggttagtatactgcttaataatgtgatgaaactgtaaaaggattccattaaaggggcaaggagtggtgttaaagattatgtaggttttcacttatcctttttaaataggaaagagtttttccttaggatcagctataggggcctttttagtctgggatgtttccttctgaaataggagacacaaatcttccaatggttcacaggtttatcgaggctggtctggctgatcttgggactcctgagctgatggtcctacaggttcttcagggggtgtccaaagtttaactcgcatgtagtgaatccaagattccactcctgccaccttaactgcagtgggggtagagaggattactgagtatggtccttcccacaaggaatccatagatgaggaggaagaggggagggacttgaccaacagtaaatctcctggttggaacaactctgttcccttgtctctgtgacatcctttgggtaggtttttaacgttttgttggtattttgccaaagaagttatatctttgaccaacttggccgtttcctgatcaagtaggaggtcatttgtgagaaaaggtcatccatacagcacttcatatggactgagccccattttgtgaggagaattttggattctcaacaaggccatgggcaagagagtaggccatgggagatgagtttcttgtgttcgtttccttaagtgcctcttgagtgtttcgtttgccttctcagccttccctgaggattgtggcctccaggcacagtgaaagtgatattgtatccctagtgccctggaaattccctgagttaccgtggctttaagagccggaccattgtcgttttgtaagctttggggaagcccaaatctgggaattatttcatgagttagtactttaaccacttcctgagccttctccgtcttgcaggggaaggcttctatccaatttggttggtcaacacagaccaacaagtattgaaatccccttgacttaggcatatgggtgaagtctaactgccagtcctctccaggatagtgacctattctttgttccccaaaaggggccttacgatggaccaagagatttttcctttggcacacctcacaggctttgactacttgttggatggtctggaggagatatggccccataaatagggatttggccatttgatgagtgttctcaaacccatgtgaaaagtttggcagggggtcttaagtattttccactggctggcttcggatatgagtacctttccctcttctgccgttaaccaccccaaggggagaaaactatgcccccgtgaaagtccccattctgtttcgatcagggagtactggggcttaatctcttggagggggttgttccataccatgggtccttccataggtatttctaatgggaggttctgcctggcagcaattttggcctcagcatctgcccagtggtttccttctgccttttctccttcacctttttgatggcttcagcagtgtaacactgccacctccttgggtttttgcactgtgtgcaataactccataatttccttgtggtatttaatgggggttcccccagaggttaggaactccctttctttccatattgcagcatgggcatgtaggattagataagcatacttgctatctgtatacacatttattcttttttcctttcccggttctaaggcttgggtaagttctgctaactaggcgctggtccgtggggggaagagacttactttcaagtactgttacatcactaactatggcataacctgcccttcatatcccattctccacaaatgaacttccatcggtatataggttaaggtcaggattagctaagggtacttctaagagatcctgttgggaagcataagtctgggctacaatttgttggcagtcatactcgattggttctccatcctctgggagaaaagtagcagggttgagggctgcacacgtgtgtatttcaagcaccagtccctgaatgagtagcgcctggtacctgagtaggtggttttctgatagccataaatttcctttggcacctggtatgccatttacatcatgagtagtctagatggtgagatcctttccttgtattattttgatagcctctgacactaagatagccactgccacaactacccgtaaacagtgaggccagccttttgctactacatcaatttccttacttaggttgtggggttccttccttactggttgtggggttgtcctacaagtctgagtaaggactccaagagctattcccgctctctctgtgaggtataaagagaagttttgtcctggggaaggcttaagtcttgagtttgtactagggcctgctttaaggttttgaaggctgtttctgcctctggttcccattctactagatgaatatttgccctctcggtctccttgattagagtatagagtggcctggccatctcgctgtatccggggatccatagtcggtaaaagccagtgatcccaaggaacccccacaactgttttaatgtgttagggcaaggacaagccagtataggctgtatttgttctttgctgagggccctggttcctctggctaggattaggcttagatatttgacttgttgtaggcagagctgggccttcgatttagatgccttgtacccttgattagctagaaagttcaagagatctagagtagcctgctggcatgaagcttccgaactggtagccaaaagtaaatcatccacatactgaaggaccagcatgcctggacttgagaagtggcctagatcttgggacagtgcctgaccaaacagatgagggctatccctaaacccttgaggcaagaccgtccatgtaagttgggttttgtggtctgtgggatcctcaaaggcaaagagaaactgggagtccaagtgcagaggaacgcagaaggcagcatccttgaggtccagaacagtgaaaccattctgcttcctttggtatttgagagagcagggtataggggttgggtacaaccggatatagaggaattacttcctcactgatgagtctaggatcttgcactagtctccactgacgattcagtttttgtactcctagaattggggtgttgcaggggctactgcattttcttactaagcctcgaacttttaaatgtataacaatatcctgtaatcctttatgagcttcaggccttaagagatattgcctttgataaggaaaagtggtggggtcttatagcctgatttggactgggtgggcattttttgcctttccgaattgtccttccaatgcccagacttcagggttgattccctcctcaagtaggggacaacaaatgggtaacttgttccccatattcatatagttaatggctccagctttggctaatatgtccctccctaataagggtgtggggctttcaggcataagaaaagcatgtgaaaagagcaaagtctcccaattacaactgaggaggtgggagaaatacctggttacaggctgtcccaggattccttggatggtaatggatcttgaggacagctgtctggggcaggagattaacactgagaaggccatgccagtgtccaggaggaagtcaatttcctggccctcaatggctaaacttgcccagggctcagtgagggtgatgacatgagctggtgcttgcaccaggcaccctcagtcctgttgttggatcatctggttgggggcttctggcccggagaacctttgtcctctggggcagtaccccgtctagtgattgccttggcatagtggacatgggtgagggagtagcttgtttcttgttggacagtcttttttaaggtgtccttgcaaaccacactgataacaagccctactgggtgattggcctgctccattttctgtcctctctgaaccaccaaggtttgtttgtctgagggccatgactgaggctgcggcctttctcttatctcgcttttccttttctgcctgttcctcttggttcctattagagaacaccgcggttgccaggtttaataatgcctccagattttgttcagggccaagggctcgcttttggagctttctcctgatatctcagctgattgggtaataaacatcttttaggatcaattgaccctcgagggagttgggtgacaggggagtatattttcttaaggcctcccatagctgcttgaggaaggcagtaggattttcttcctttccctgagttatggtggacatcattgaataattcatgggctttttcctaattctccttagtccttctggaatacaggtcaacagatgtttgcgactccagttcccatgatctgagtctaggtcccagtggggatccataatggggatggcttgctgcccattagggaatttgtccctttcttcggctgtcattttgtcatttacttgactaagataccaggtatctccaaattctcgggctgcagctaaagctgcattcttttcattaaaggccagggtttgatctaacaatagcatgacatctctccaagtgaggtcgaaggtttgccctggaccctgtaggacatctatatacctaccaggatcatctgaaaactttcccaggtctaccttgatctgctttaattcagagagagagaaggtcccatgttgggccaaattcccctccccctacagcttaaaggagacataactgatagcctgaggggtttggtggtcctttggaaatttctttgcttgtttccttctggatggaggagattagaggaggctcatcattaataggaaggggagctgtagggaggctaggatatggaggtaatctgagaggtcctcctgtggaatgtaaatcgccagctttgcatagttgtggattatccttcagtaaaaagaaagcttggacataaggtatttcactccatttcccttccctcttacagaaaaggtcaacctgcagaatagtgttgtaatttatacttccctcaggtgaccatttttccctattagagagataatattaaggccagaccgtagtgcagaaaaaataagccgcttctttttcagggtttgcgggacaaattggtcccaatggcttaggatgcgtttcaagggtgagcttgttgatgcctgggtgtttcccatctgaaagaaaaaaccgcctgcagttttttttttttttctcttctccctgcccaagaacccacaacagtccctggatcctgctgttcggaatagctgtgctcaccaaagcagcagcggaaacactagttttcctcctagaccacaaaaaggactgaggaaggtcagatttagtggcccttaccaatggattctcaaaaacctgcacccttgcctttcgtctttagaccacaaagaggactgagaaaagtcagatttagtggcccttaccaatgcattcttgaaaacctgttagagtcctaagtgttttctcctgttgttattaggaccttacccttgtactataaagataatatgcctcaaaatggagtggagggccataccctgagggaaggaagggatctccagggttggaagagtgatgcgttttgtcctcacttatcatatgaataggaaggatataatttctgagtctcctcctatcctagctttgggaatagcctttgttaggtctgctagtctgaggagggatcctaaaattccagatagtcccccacaacagggctttggacaaaaattatgtctttctgattggtgagcctgggtgcctaaagaagggagcagagtcctgaaatttatattagaaatcatccttataggagaaactggaagagcaccagggacagggagtggtttttagaagcaagactaaccttggagaagagaggcgggagaaagtttgtctgacaggtgttaggacccaggaggcaagggtcaggatagataggatagatgggtgagtcttgtttgggctatgtaactttgagagttctgctcatggctgcagggccaaccaactttttgttgagaccccggagctgaatggctttcctctctgtcgaccctaggcttagcccggaagtgcaggaaaagcagaagctggttccaggcaaaccaatgctcctgactccaaacagtcgggggttgttagtgagccctttcccagagagcctgacatccatgtccttagtcctgtggccatgctagttgcttttaactggctgacaggtgcctagttttagcccctgaattctaaggaaaaataggacagaatagcaagcaaaaggggtctgatggtactcaccacgttgcaatatctgggaggatcccccaagatgtgtccagagttggttccagccggtggattcatggtctcgctgacttcaagaatggaggcacggaccttcacggtgagtgttacagctcttaaagatggcacagacccaaagagtgagcagtagcaaggttaactgtgaagagcgacaggacaaagcttccccagcgtggaaggggacccaaatgggttgccactgctggctggggtggcccgcttttattcccttatttgtcccctcccatattctgtttctgtcctatcagagtgccatttttttcaatcctccctgcgattggctacttttatactcctgctgattggtgcattttacagagcgttgattggtgcattttacagagcgttgattggtgcattttaccaagtgctgattggtgcgctttacaaacctcttataagacaggaaagttcctgattggtgtgttttacaatccttttgtaggacgggaaatttccccaagtccccactcaacccaggaagtccagctggcttcacctctcatttttatggcctgaaagcttatttgtttttagtgctgaataatattctattgtatggatgtaccacagttcatgtacccattcacgattatgaatgaagctgctataaacatttgagtgcaggtttttgtgtggacttaagtttttagtttatttgtgtagataccaaggagcatgcttgccacattgcatgttaagagtatgtttagctttgtaggaaactgccaaactgttttcccaagtagcttactatttgcattcccacccgcaatgacttgagagttcctatggctctgcatccttgccagcatctgctgttggcagtgtgttggattttggccattttcataggtggtatcttgtgtttgttttaattcacagttccctagtgattcataatgtggagcatctttttatgtgcttacttgccatctctatgtctaatttggtaaggtgtctggtcaggtcttttgtccattttaaaaactgggttgtttgttttctaatagtgaagttttctacagctctgttgtgtggttacttcttttttacatcaagatgagtcttactacctggttagattgggtgttacttgtagagatgctctccttccttccttctgtctcctagagcatttgccacacttcagatcctcagtaaatacagtcttcccaacccaatgcctgccacatgtttcctgacctcaagttcatatatcctctcgcattccctttactcctttccatacataacagtggtggtcactgctgagtccccctgaaggtgagcttatctacctctttttatatccaagctgcttaattgctataatatccaagctcccagatcacagcttttagttctttttctgaatctgaactggtgataagattaagaaatctcttggttcttttgcattaatttcttggttttgctgtctactataataatttaatagcatattttaaaaatgtttctgatggctgtttagttttgtctgctgactacaaaggttgttttgacctcatcttgctgacctgccaaaagcactaagtctatggcagtaagagagtggaaagtctgttccagtctctgtataatacaattacatgtactgtgtagcaataataattaacatgggaggaaatcagtacaaattagggatattcctgaatcattggctacactgtagataatgcagcttctcaagccagtttgttacaaatgggctacaggtatatccaagtatggattgcctcagccctcaggcagccttgacccctgaggctacagagcccctagcagggggggttaaccatttatgcaattatgctgctgcccagatgttattttctatacaagtagttcctttagagagagcaagtgcaagccccaagcactggcacaatatggagtggggaaaacaatgattttgaattcagaagaattcagttcctggtcagctctctgatggcagggattttgtctgctcagctcactgctctatccctgtacctaaatcagtacttggcacactgtaagcactcagtaaatatttatcgatctaattcttctgtttttttttttttttttttttttttttttgagacagagtctcgctcttattgcccaggctggagtccagccatctcagctcactgcaacctccacttcctgggttcaagcgattgtctgagtagctggaattacaggcacgtgccaccatgcctggctaaccttttttgtagttttagtagagacggggttttgccatgttggccaggctggtcttgaactcctgacctcaagtgatccgcctgactcagcctcccaaagtgctgggattacaagtgtgagccatctcgcccagcttcgatttaattattgaagcatacttgaattcaagcatgttacttaatcctctctgcacctcattttccagaattagaaatatagtttattcctatacagcagatataaatttatgtgtagacagttgggctgttgttgtaacctaaaagtgacatatgcacaacctgtagcacaatgccaggtacagagtaggggatccagtgggttctttcttaccctctttcatttgaagtttttaaagtatcaggtgaagatgatgatgatgatgataatgataatgaaagtgatattttttgcatacatttcagtaaagttcattaccttacactgatgtaatcctcagagcaattcttagacaattatggttttttaccccctctttattttattttatttttgagacggagtctcactctgtcgcccaggctggagtgcagtggcgcaatcttggctcacttcaacctctgcctcccgggttcaagcgattctcctgcctcagcctcctgagtagctgggactacaggcacctgccactacgcccagctaatttttttgtatttttagtagagacggggtttcaccgtgttagccaggatggtctcgatctcctgaccttgtgatccacccgcctcggcatcccaaagtgctgagagtgtaccccctctatcaatgatgagactgatgctgagaaaagtaacatgattatgtaagattacacaagtgaaacacaccaaaaacagaccttgaacccagtttttttattttctcacgtcaacttttcctccacaccaaatctaataaaattttataaagaattactttaaagactaaatcactttcgactagcatgttgtctggatgcaaatgatggtgataaagtaagtttaataatgcttaaaggaggtaaacaattcctaaaccttttaaaaaatctagtcagctaaagtaggtttacgctaaactttcatcagaatccttaaattctaaatcttgaacttttaaatcagtaatagagttttaatgtgaattaattgtctgtaacattttcaaaagataaaagtgataaatgcacaaacctacctgctattataaaacttgttgtggtggaatgagacaagaatagatgtactataagaacaagagggatatgaagaggcaggtttatgtcgatacttaaaatacatttgacgccatccttttgacaggaaggaatgtctttaaaatctcacaccagtgagagtgggaaaaaaatcagccatatttctgctttttttaccctttcattggaatgctcagtcacttggtctactctggttttgattcacaaatgagttttcagaaatgactgtcccactggctttttaaaagaaaaattcagtttttcctctgaagactgacacacaatcactcagagatggataatcctaaatgttttccttttccagctgaatttaatcttatgctatcaacaaaatctggaaaggtttactttctcatatcattcattactagttatgaattctgaaccgtatttgtaacctgttcatcacatattcatccctgcatgtattcattccctaaatatttattgaatgccagcaatacaccctgaactcggagaaaacataatctttaccctcaaaaagctcacagtctggtgctcagttgaccaaacatcgtgtttcttttctaccgagttgcaggtcttctctctgtggatgtcattgaatgtcgtttgcagaattctacttgctatagtaggcatctgtcttgttcatgagccacattacaacctcgtgtgttataggcaaaaaggcaatctaagaacggcctgacattcggacgcctaaggggacttccctagtgagggcacaagacagacaaatcccagaatattttctatatgcagaggaaacttctctggcatcttagaaagacaaagacagcaagactgaagatagaaacaggaggatagcaaccttttaaacaacttgtttttgtgaaatttgtttctgtttgctttgagaatgggggaaaagagaactctaattacaaactccacgtttctttcaactatactattttctttctttttttttttttgagacggagttttgctcttgttgcccacgctggagagcaatggcacgatcttggctcactgcaacctccgcctcctgggttcaagtggttctcctgcctcagccttctgagtagctgggattacaggcatgtgccaccacgcccggctaattttacatttttagcagagatgaggttcctccatgttggtcgggctggtctccaactcccgacctcaggtgatctgccggccttggcctcccaaagtgctgggattacaggcatgaggcactgcacctggcctttttttttgagacggagtctcgctctgtcgcccaggctggagtgcagtggtgtgatcttggctcactgcaaactctggccctcgggttcaagtgattcttctgcctcagcctcctgagtagctaactaatttttgtattttcagtagagactaatttttgtatttttagtagagacagtgtttcactgtgttggccaggcttgtctcgaattcctgacctttggtgatccacccacctgggcatcccaaagttctgggattacaggcgtgagcaactgtgcccaaccagttatactattttcaatcctatataatttgtacagctgaagtggcaactgcttgcttttaaatgggaagagaagatgtccccatttaatgcttagaaaagattgacttcggtttaagccaaaggagcatcctggagaaccgaatgattcatgattagtaattctcaaggaatggccatgtggctcttcatagcgttggcccttgggggggtctactttaatctttgttctaacccccgccgcccctgttgtccttttaatcctcatggatcaggtgcgttcacagataaccactaaagtgaggctgaaagaggttaggatggggatggacacctgtatttctgagaggacctctccatgatgtttaggaatggggttgacatccttcacctagaaggtcctttcccaagattggacattgattttggtcgctggagcagcctcatcagcatttctacaaggtccccagaagggaggaagctattcattgaatacttcatatggaggtggttttatgttatttttatgagatattaaggaatcttcagaaactcatagcatctccatgttgcagataaaagaggctcgatggaatgggagtgagtcagttcagagttactctgctaataataaacgtgctggctttgaacctacgtctctctgagtaataagcccctgccctctcttccaaagcacattccttcccttgaatcagagagcactagatgggaagggtgatgggagctacattatcactggcagatggaactattcagctcctgtccttccattctctaagaaccatgcatgtgtgtaaacacatgttgcatcagtgattgttccaggctttgcctacttgctcccaaacatgtgaaaaagaagaggaagattaagtaagtcattcatatattacttatatctgagtgtttgcaatcatataggggagcatagttcccacaaggaccggtttttgtaaacttttgcttctctttcctgtatttaggcattatatagctatggcagtgatcacccacaggtacaaattctgtatcattcattgcctttacttggaggtttacaaatatttttagtctctacttctttttcaaacacaatcttgaaacctcaacatatgaaacgaataaaggaaaattttgttagcataatgtatgttagatttcagcgtgtaatgctgacttataaaatcaagaagaaagaacaatgaagctttgtgatgaacacagaaatttgaaagcagtgttagagatgacagctgcaatcttctttaacttcagtttccaatttattgccttttgttgttaggtatattttttatgttgttgtgcagtattgagaaaaccctgattccctaaaataaggagttgcaaataataatgagttgttttatttttttaaacagttaccttgcaagctcaggatatgttttcctttaaacttatccacttaaaacgtgttcacttaaaacaaaaggaagaaaagaaatggcttctttcaaagctgatatcgctaacaatgtgaaaccatttacattttttaattggtaagcctgcgatttggaggaccaatgatagcttcctctagcctaaatcttccattagagggagaaaacactttttaaattataacattaatgagatgctcattgatgtacttaaaaaacaagaagaagaagaaactcataagcctgagggagggctcatctctttcaattttagaaggaagaaattgtctttgctttgcatggtgggtccaatcttgaactttagatttaatctctgacattggctaccataagcatggtatgtctgacagtttaatgccaataatttaattttattacaccattttatactacatgtttatttattacataccaaaattcactgaggacaagaactcagggtgttttgtctggtcttggccgttaattgtccatgatacactcatgctgtactagggtgctcacttgtgaaatttcatgcaagtggacgtagggagaacttaagtttatatgtttaaaaaaagcaatggtagcgctacaacctttctacctgagaaacaggatgtcactgagatgacgggatacctttattttgagatctacacaagcctggcagtatggtctggcccattagtagttgtggcaatgccaggatggaagttacatttgattaacggggtaactaagaatctaacttcagaagaactcttgctatcccctttaaccctcacaacaacagcaacaaataaatcagttggcaaatcttgaagatgtagagccttactaacaaaatggagttaagaaaacccttcatgcaagcaaaaaagcttgatctctgctagggacatcaaaggtgcagtggtgtggacgtccagacacagatctgatgtaggctttcctcttgggccttagcctagctcagtggttttcaaattccactgtatgtgagcattgttgcacagggtggtataaacaaaaactgtatatagtgtccttgttgggcaatgtaagacacttttatttattgagccaatacttacagagtgccttctctgtgctaagactcataggtgctgcagtttgagcaaggatgaagagaagtcagttaatgggtgatacaaaaatacagttaaatagaaggagtaagttttaggattcaatagtacatatcacttgtacccccaaaatatgtacacctgtgatatatcagtaatgaataaataaggagcatcattctagcgcaggaaacaaaccaacaaggactttgtggtgtaacatcagctgtgatgaatgaagagaagaatcagaggggcgagggaagagggggcctgctcttttagacaaggcgaccagggagggacacatcacagcagagacctgaatgaagagaactcatttgccagaggagcattctaggtaggaccaggattgtgcctggatgtggaagggagtgtggaggccactatgctggagcagaacatagggaggagatgggcaggaaaaaagaggaggagggtttcacatagttggggtcagatcatgtagggccttctaagtcttgacatggaccaggactgtggtttttaccataaatgtaataggaagcattgaaaggtttgagtggaatggtattaggatctgatttgcaccttacaatttcaaggatacttttgaacccacacactctgcattgggtgggaactttagaccctagcccctgaattaagtgttattctactatatggcacatggagagcttttctgaaactacagttacttaataatgagaaattcaatttaaaaataaaacgcagatgctctgaagcccgttggtagaatctttggggcttttaaataagtttaaaagctacaagcttcaataaagattaaattagaaatcctatataaagcttctaagagtgtaactagcattttagtaatgcttactaagtgctggttctgtccctttctgctctcctattttttttatcagcgcctttgctattaggccaggcgcagtagctcacacctgtaatcccagcactttgggaggccgaggtgggaggatcacttgacgccagaagttcaaaaccagcctgggcaacatagtgcgattctgccttgataaaaaataaaaataggcagggtgtggtggctaacacttctaatcctagcactttgggaggctgaggcaggtggatcacttgaggccaggagtttgagacaaacctggccaacatggtgaaaccccatccctactaaaaatacaaaaattagctgggtgggtggtgggcacctgtaataccagctactcaggaggctgaggcaggagaatagtttgaacccaagaggccaaggttgcagtatgctgagatcatgccactgcactctaacgtgggtgacagaacgagaccctgtctcaaaaaaattaattaattaaaaatttttaaaaaatacaattaaaaaatacctttgctattgatgtctgtttctgattgtctgtcatcccggtacactatatttactttccagggaaactgagtcattcaacaagcctctggcttctagtgataagcactatcattagaaagaattatgttctgtgtgttaaggataagggacacattctttttggaaaatagtgcttgtgagtctaggaatagttgtataatctgggaatatatgctaatgctatagctgagttcaaatcacttttttaaaaatgcaaacttatcttctctgtcaccaagcatgtcttccatacaaaaggcacatttctgtagcttcatccatgttactctaggctatttcctctagtttattaaccacacgctcagcaaactgtagagagtatggtctgatccctttctcccataataaaaattttaagactatgtacttgttgatagatgacaccaacaggatatattttacagaaatgaaacaacaacatgtgaagaatattttaggtcactgtaaagttcctttaatagaaaaaaaactttagatttaactgttaaaccctttgaaaaagaaataatttatttcatgcaaatgactaaagcaaaatggagtgtgcagaagacctacctgcatactgtatgtaaaatacagttttctgggcttcactcccaggaattctgattcacaaatctggggttgggcagctttcaattttgagaagtgccccgagtaagctgatgtcaggaatgtgaattttaacaggcaccccaaaggaaggctgtgggaaaccacatttgagaaacactgccaaattaccaaaggaactttaactttgtgttatagaaatatcaaacacatttaacagacacttctcaaaagaagacatttatgcagccaaaagacacgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgcaataaagacacatgcacatgtatgtttatggcggcactattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatacacctaatgctagatgacgaggtaatgggtgcagcacaccagcatggcacatgtatacatatgtaactaacctgcacattgtgcacatgtaccctaaaacttaaagtataataataatataaaaacttaaaaaaaaaagaaatatcaaacacatttgaaagcagagaggtggtaaatgaacgcttttgccccaccaccccattcagcagcagagccaacatcgttttctctactccacctctgcacctggattattttgaagcaaattccaaataacagtattccctggaccttgcatcttcataacagattgctgttgactcaaaatatctataaaatattttactatttctataaatgattaggattcttcttctcatacacaactacaacatcatcatcacaccaaaaaatgcattaacagtcatttctcaatatcatcaaatatcccgtcagtattcatattttcctaattgacttattaataagttttattttatgttgtaggattttttaatagtttatttgaaccaagatccaaataaaggtcatttcggtctcctaaacctcttttacactactcggtatcacctatgtcttttttttattttgcagttttttctgttgagaaaccagaccatttgtctggtagaatttcccacccgtctgggtttggatgattgcctccatgtggtgttgctaagcatgtccctctgtctcctgaatttcttgggaattgctaggaagttctagaggcattgttttgtttgctttgctttgcctgactgcttcatagttggtgttgtgttgtgtatttccttcaggaggtaatggttggtggcatctctttttgcagtgagactgtcatctgaattcataaatttatcagggattgcaaatagtggtagtctaattctattattatttgttcatttgttagcaggaattattgttcatgaagagaaactccttgcatctgtaatttatctacccggtgcttcaggttttgtaggaaaagcaggataatatactagattctgtctatttaccaatttgcacgatacagctagttcacagtgtcaaaccaagtcactgtgttttgaaagcatgactgtaaattcatagattgcagcatatctgttgtgtttcagtccatgacagtgattaccctttttcatgttcagatggtcccctgtctgagcattgggatcctattcagtttggctactgagtccttttaatccaatactggctgtctttgatagttttcttgctttctagtataacactatgttccaggctcatcttgtacatttcttgccttagctctgggatcagcttttttccaaggagacctggtttctttcagtgagaaatgatatttggagaccaaagactgggccccaggggaactgttctcactgggttgaatattgtttttcctttccagtggacacagccagtgataggaaatctgtgtctctctagatatagatatagatcgattgtgtgtactttttttttttttttttgagacggagcctcgctctgtcgcccaggctggaatgcagtggcgcaatctcggctcactgcaagctccacctcccaggttcacgccattctcctgcctcagcctcccgagtagctgggactacaggcgcccgccaccacgcctggctaatcttttctgtttttagtagagacggggtttcactgtgttagccaggatggtctcgatctcctgaccttgtgatcggccctccttggcctcccaaagtgctgggattacaggcatgagccatcgtgcctggccgtgtgtacgtattttttaaggtaaaatacctcatgagtttatactgatgtgccacaaggcttttacttaacttcattcattttacatcagtattttctttctctcaaactgaaaatagcagttctcactcacaccaacacaatttactcatttactttctcccacactacacttgcaataatttccgaacaaaaatgccagtgacattgcaacaatatgcttactgaaaatgtttaaggttttttttattttgattgtttagttttgtattggtttttagtccactgggctagagatggacaattacattacaatatgttagggtcatttggaatagttacagtctgtgtgtttatgccaataactggatatacatttgagttcacttactttaatttgagacttcctaagaggcttttgaaaagtgattcttgttcaataattatataaaaatatttaaattttcctgaaacaaaacccacaaaacaaggtgaagtcgttgaagtctgtctttcatgcctgtctgctttattttctcctttttaccatttttaggcatatctttcatttttattataagcaatcatactatttaggtaggtttttttttttttttttttttttttgctccaatagatttatttatttatttagagacagggtctcactttgtcacccaggctggagtacagtggtacagtcttggctcactgcagccttgaactcttaggcttaagcaatccttctgcctcagccccccaagtagctgggactacaggtgtgccccaccatgcccgctattttttttgtttgtttgtttttccagaccaagccttgctctgtcacccgggctggagagcagtggcaccatcttggctcactgcagcctcaccctcctgggtttaagcaattctcgtgcctcagcctcctgagtagatgggattacaggtgtgcgccaccacgaccaggtaatttttggatttttggtagagacggggttttgccatgttggccaggctagtctcaagttcctggcctcaagtgatccacccgccttggcctcccaaagtgttgggattacaggtgtgagccaccatgcccagccttccagtaaaaatgtttagaataattccttaatatggtacccttcttatcccccaaacttttcttagctgttgtttattggtttccaactctgagtgattttgaaattcttagtaccctttctttcttattttcttctctggctataatttgatttaaggtaatatccttttactcccacttaacatctatgttagtgagattattttcgttcctttcatattcttcccgcgtgtttttttttaatcattatactatctatattgtcagggcacatagtcattatatcgttctggctatatgtaatattgtttccttgtaatcatctttcagtaacagacctacagctgattatgtgttaaatgctcacccagtctttgtatcagtgcctttccagccagactggttgcctgactcttctcccttgcagattactaagggtttctgcgaacaatattccttgggtccttgcatattcataacagattgttgttggctggaagatcattttggctgggtataagatccttggcttagttgtctttcctgagtgtcacgctactgacttttagcatgaagcctggctcttgaaaaatcgggtgacactctaattttctgtcccttataggtaactcagtcattttacctgagtgtccaaagaatttttttttgttttctttcctaggtcagtttttccaggtgcatggagtattctgtcaatatatagtttcaaatctttttctacttctagaatttgtgcttcagtcacgattttaagcatttgctgtttttattgcttttcttcttcaaaggctcttattacagtgttatgttgggttttctttgctcatgttccttttctgagtctttctcttgaattctatttctttcctcatttctttttgatgtttaacactttctcctttctattttttagcactcctcaaagattatctgttgtatgtattccctcttgtgttccttcttatttggtcttcatctagaaaatggattttcttttttcgttttcttcaaattctttcccacgttcttttgcctctctctatccaactatttcttttctccaatcacttcatttctgaatgtttttattgggattagtgttcctttatctcttcttactgcctcattttcttttagctcttttgaaatattaaagttttcatctgttttgggggcatgtctctgtggtaagaatgctactctgatttttcttcttataataactgtgcactgtatttgaccacaatcctattttgttactcatttttaagtggaatgagttttcttgtatttttagggataagggatgggccagaaaatattttctagtgtctaggccatagaactccgtcttctgttgtttccatggaataaaataaggcctatattttcttagcttcgtcttctctgcctcccttcacttggatctgccccctcccttcactttggctaaattattactgccatgttcgatttagattctgctctcaaaagtttcttctcaaggtgatttggtcgtggaaggaagcttagatttgttggtctcaagagtgccctggctccgtaacacctaagcacctcagaccttcccagggttccttgccctcaccccatgaattggattctgcaggaccccttgccaatgatgctgctgtgctcaaaatagctcaccaccctgctgaccgtgccgtaaggacctttggaagcttgggagcccgttgtgccaaaaccttcagatgcccactgcctctcctccaactttctcttgcacagatattgcttctgcctggctctgtcactataaatggttcggccacacccattcctgtcttcaggtttatggactacacagtaacctcattttgtcttgatgtggtccatgggtttttggctgtgtaattccaatttctctgtttttgttgttatcattgctattgttactggcagggaggaggagggcagggattctgaaaaatttttttaaactgtgctacctttgacactggtgccatcatcttccctgaattcccgctttaattttttcttttcttttcttttttttttttaagacagggtctcactctgtttcccaggttggagtgcagtggtgctattttggctcactgcaacctctggctcctgggttcaagcaatcatcccaccttagcctcccaagtagctgggactaaaggtgtatgtatgtattccctcttgtgttccttcttatttggtcttcatctagaaaatggttttttttttttcttttacttcaaattctttcccacgttcttttgcctctctctatccaactatttgttttctccaatcacttcatttctgaatgtttttattgggattagtgttcctttatctcttcttacttcctcattttcttttagctcttttgaaatatcaaagttttcatctgttttgggggcatgtctctgtggtaagaatgtgccaccacgcctggctaattttttgtatttttggtagagatggggttttgccatgttgcccaggctggagactcctgggttcaagcgatccacccatttagacctcccaaagtgctgggattacaggcatgagccaccgcacctggccccacttcaatttttttttttttttgagacgaagtcttgctcttgtcccccaggctggagtgcaatggcaccgtctcagctcactgcaacctccgcctcccgggttcaagtgattctcctgcctcagcctcccgagtagctgggattacaggtgcctaccatcacacccacctaatttttgtatttttggtaaagatggggtttcaccatgttgcccaggctggtctcgaacttccgacctcagatgatctgcccacttcagcctcccaaaagtgctgggattacaggcgtgagccactgtgcctggccccactttaattttttaatagtgcttgagaagatgtttctgctaaatactatgcctctggattaaacctcaaatacttcaaaatgaaaagtttgatttcggtcacagatttttagtaaatactttttagggacaagaaaactacaaagtgctttgaaaaacaaaacaagctcaattttttatttgtttaacatatgtagaaaataaaattaatacacgtatcttttccaaattaacacagtatgaaaccaaccactactaattcatcaaaagacacaatttagatcaagtttaggcttggttaggacgctggacgctgagtaaatggtagctctgaggctgaaaaaaaacccctgagtcactctggtacacattctgatgtcagcatccccaccccaccccaacccttattcccgccccgcccccggccccgccccccccccccccccccccccgcgaaaagaagtctctagctctgaaaattggcttgttataactttacaaatgtagttgccaaattgccattgacatcacatttttctttttggcttttagtagctagatagtaatactataaaggaactctctgctttttctattttgtcctttttaaattcttggaggcccttcataacatggaacacaggatgggcaaacgtgcttcttatagtgtaggttagatttagcaccttttgacaaagggccttgtttcctgtgcagtttaaatttagatccactgagaatctgagaaattcagtaatgaaagggtaactttggagtttcctcttttggaagctttccttattaaattctattaatgactctgttagacttgattcccatcttacacaagagattccagaatagcaacttgaattgcttcttagtccctcttacgaagtcactccttcatttggcattgatcgagtacctcccgtgtactggctgacggggcttatatacagagccactaccttatttttcattctgttattttaagagtttcttgatagtccatctacttaagaagtgttgctattaaatttcagtctatctcataaatattattctgagatcctcctggctggatttataggtataaatcattcttggataaaatatacaatataaacagtaagtggaccagttatctgattatacgtgctctgagtctacagaaagacaatatcttggtatgtttcaggagacttgtagagatgaggtgtaggacttctcatttctaattaaaactaattaaaatttactgtctacaagggagatggattgaacatcacctttacctttctcttgacagcaatgaaacctgactcaaagctggcactaaatgtattatttcagtatctgtgtcctattatgtgttgtaatattttggattaaaaaatggagaaaaaataaacaagaaatttttatttctgctaaaaagtcaacagagtccattgttatctttctttgcttttcagatggcagaaattgggtgtcaggtcctataacacaggggttcccaacccctgggccatggaccattatgggtctgtggcctgttaggaactgggtggcacaccagtaggtgagaggcaggcgagccggcattagccagctcagccagcctaagctccacctcctgtcagatcagtggcagcattagattctttctcataggaaagtgaaccgtactgtgaactgcacatgtgagggatctaggttgtaccttccttatgagaatctaatgcctgatccccctacccctagcctcatggaccagtgccaaaaagtttggggaccactgccataagaagtcccgaccagaagtgtcacatctttctattgcatgatgctgcttcttgaacacccatagtagccaaggccagaattagtgtggcaccctcttccccagacaaggtccatggacagtgcatttcaaaatacaggaagctctccttacactctctgctacctagcttccatggttatcaagtaattatactttatgctgagccaacttatgcatttaggaagagatgaagagaaattatatcctcaaatgggctggaacaaaagggaataccaataatttgtaagttaatcaaattataattaaagcaggaagagacacaaggagcttggattatctatgttttctgttagaaaataatacaacaaaagtatccagggagtcttatcagttctgtaggaatttggcagaacagtaaggttataagttgtccttttaattcccagccacctctggcctctgcttaccatggccctgccttctgacttgctgtttgctcagctccttagtgcatgggaagagcagaaacatcaggggaagagcgctgagatctgctgtgcacctgtgccgcacagcccttcccatgtagacatgtgtagcttttgggtttgccagtggatggaacttatccgcatcaagtagccttccacgggggtggtgctgatacgcactcccacccacagccgatacagcctaatcacaagtggaacaatcagagtggaaagtagcggaaagtagcagcctctggtttccaaatgtgagagagcctcagggctcagtcctcaaacctggtctgttttttgttgatgccttcaaaccatctcaaaactgacaccttctccagcctgggccttttctttgaacctcaggcttgcatatcccactgtctcttaactgccttcagtgggatgaactcttgatattctaccccaacctgcttctcccactgccttcccatctccttccagttactcaggccacagttgttgacgttgtccttgatgcctctttttctcctacacaattctgctggtccacggtgccaccatctcttggctggagttcatcagtaacctcctgagtagtctctctgcttcttctcagaatatctcctccatgcaacagccagcatgaactggtgaaaatgtagtccagaccctgtacctcctctgatcaaaaccctccagtgcctctcagctcactcagagtaaggacctcagactttattgtggctcaaagaacttgtcacccccaccctctgacttcatttcctgctccccaccccctttactcagtgccaggaacaccacctcgatggtgttcctccaacacaccacacaggagcccaccccaggaccttggtaccttctgttctttctgtcaggaaggctcttcccccagtcaccacattgctttctatttccctttcttcaggcttttccccaaaagttactgtctctgtgaggtcttttttgactgacaagcttgaaaaaatggtcaccagaccaccaccctagcccccttttctgcttaactttttagcatctatcaccatttaatggaaaatacttcattataaatcttttatttccatgaggataggtaattatttgttgttgggggtgtctttgtcagcatctagtacagtgcctggcagatggatgctcaataaatattgatttaatgggttatgagggtgttaatataaaattagcatttattcagcaactactatgagtcagccactgggctaagtggcttacatgttaagaacctcacagaaggccaggtgtggtggctcacgcctgtaatcccagcactttgggaggctgaagcaggcagatcacctgaggtcaggagtttgagtccaggctggccaacgtggtgaaaccccatctctactaaaaatacaaaaattagccagttgtggtggcaggcgcctgtagtcccagccactcaggaggctaaggcaggagaatagctggaacccgggaggtggagattgcagtgagccaagattgcaccactgcactccagcctgggtgacagagtgagactctgtctccaaaaaaaaaagaaaaagaaaaagaacctcacagcaacctagtaggtgagcactgttactcttgttttacaggtgagaaaattgagccctagagaaataaagtaacttgcttcaggtctcatggttaaggggaacctgggccctaacagtccacttcctgtaccttcaaccacggctctaccgcctccgctaggagatggcccgaggacattccttagctggcttcagcttgctctttttcccctgcggtccacccctgtctcctgcttggtcatcagtgatttccatgccatcccatgtcattggaccagttgtgtgtttttaataggagttctcatctcactttctccacagctttgccaattctgctctccccctcctgtctaaataccttcctcccttggcttcctgaacaccactgtcttcgggtgccatcatccctttctggcccctccttcctaagtcttcaggtgttccctttctacctgctttctacgcctctaagtgttggagttcctcatggcttagtctctagaccactttgcttctccacttaagtgttctgctagatgatctcatccaaactcacagtgccttgatggatccatgactcctgcatccatgtttctaggccagacctctcatcatcttcgggcctgtgtctccagctacctactctgcacctcctttggggtatcacaatgtcacctgaactcagcacgttcaaagtcaaagttataacaatcaccatcccaccaaacctcatctacccaagaattccccatctcagccattggcatcatctagttacccaagacagatgcctaaaagtcctccttgaagcatttctgtccctcttcctctgcatctaatgtgtcaccaagtcctactgatgcaatctcctcagtgtctttcgaatgcactctctctcttccggcccactatcaccattctagtcctaaaacctaccttctttctaggagccacagcttctctggagtttttacacctcttccaactgttcccatcaccccgttcttttctttgacaacattttttacatataaaaataggtatttatgtgattatatcatgaatgtcttttctccccaactaagaagcactatgagagcagggagcttcctgtttctccccgttcaatcctcagctcctagcagcacagtgcctggtgtatagcagattctccatcagtatttgatttgttgagtgaaaaacttagatgtattaaatgacaaactgagatcaagggagaatgaagaatcaatcagaagcagatagaaaattatgctgtgtggtatggcaacatcatgaatggactgttaccgataatacacactgagtcatcaaagaaacattaacatgtattctctattttaaaagggaggtacataaatatagaaccaaataaacagatctcaggaacatttccattcagtaagcaaagttttagaagggaaagagaaattaagttcacatcatttcccaataacacagatgaatgttttccatccaattctgaggacaaagatagcacctcctcgcccatccatgccaacggaggctgaggtagcacagataattgaaattacagtgaagaaggaaaggggttgattgatttgcatgccatctcttttctttaatagtggaggaattgccaaaaaaggctaaaaatgggcaacaggaaaagggagaaacagtaagaatcttggataatcttccactagataattaagacttaactgggtctgttttgatgtgtgcacatgtttctgtacatggagaaggatgaacccacaaatattataaatgccaatttccgaaggcttttggaaaatgtaacccatagcatatggtgtcaaattaatttggggttttacttgtttcagtctgatttgggcacattgaattatgagataatagtttggcatccatgtttgctgagtgcttgttgtaagtttctcaatttcacaaaaattctctgaggttagaggacgcgtcgtgaccctcgtttggcaggtgaggaggtagcggcacagagccgatccgtggctcgcctgagctccggcaggaactcctgggcggagctgctgagacccaggtctgcagactgtcactctggcttcactatttctggccttcctttgagcacttttcttacttttgttctgtttcatgcacttaatgcacctgtttcatcatgctgcctgtcacagttaaaggaatttaaaacagaatggatcgtatttgacagtaaggagctgtacagctgaattccatcaagacaatgtgcttgtagccccaacggcattaaaactttcaaatgatgctttatcacaacttcctctgggctgcacgtgacaaaggggtgcttaaccaggagggacatctctctttgcttgtaggggcaggttgctgttttttgcccacctctaaaatctccttggagcactcagttcttcttatcctccttaaagccaacaactataaaatttaatttaatgttgaacagctgtttctgttgcggtccaggtgaaatttgaggtatcagctaattgtgctaaagttcccaaaaagaagtattcagaaggtgtggatcaccaattacctcttggcagagctgtgaactaataactagtagcagtagataatgtactcagatgccacatgaaatgcaaaagattctatgctttattccataaagcatggctataggacattgtctactatgtaactaatatttaaatatttatagatttttaaaagatttcttcaaccttcttttctcaccctgtttctagatctgatgcacaaaggaaaataataatacaaaacccataacctattcattgtattgttgcggtagatcgagctacatgctgcacagcaaaagaccttctttgcacttctttcaagcagaattattgctgtatattcactctgaactgagaggtgaggattgaactgtgtagtgcctcagaaaatatcaagagttttaaaacattagttttgagagattgaaatacatagaaacttggaatgtttgaatgtcagcccagacattggcaggcttccatgcagatttcattgtgagtaaaatgtgtactcagtggctgggttcaagcccttcatagtttataagcaaatgtctctgcttcttctagatcattgcaaaaaaaaaaaagaagaagaagaagagaagaaaagaaaaaagaaataggttaagcaaattttgtggtggtgcttatgtgtgcacagacatgcatgaggcctccgcatcttccaaacttggaaagcatattttaacagcacaaatatatctacatgtttgatctacatcagagcctctttttttccctcttccttgcatgcttttaaattatatagtttaaatgttttaactattaaatctgtttggtcttcaagctgtaaacatcacacacagctaataagctttaggaaagaaaaggaaattgacatttagtatagaggttctacaaaaccaatgaaaaccatgcaaatgagctatggaacagagagatttgcatatcctcgttgatttcatgatgatattctcagcatgagcctggcagccttgcctttttacctcttgggatgatgcatgtactggtggtagagccctgcagggtcaatttaacgagtgtaacattgtgattttccatgcggtttctcagaaccactgagcaaaatgcagcaataaccagtgacagaggaaatcgatttttgaagtaaatacttttggaggaggggaagaaggtacattcccttcatatttaatgttgccaaagtaggttgaacaagtttttatattagtaccatttggtatttcaaaataaatagattatccaccatttccatcactctctggataccctcacatgtttaccaccaaaactcctgcgcagagactggtcctcttttgcaaactgcctttggctcccccgcgatctctcatcagaaaagcaggctaaggaatctgcttttgcccccatcctgttagaatgataaatagtagcctgatggccaagttgtatatttatttaatacatcgtctgtattgatagtttatgatgtcctggatatgaatacacgaaagcacagttgcatagtggcgaagaaggattttgatatcgtggagatctggatttgaactcaactctggcagttctccctgccttagtttcttgcccgtaaatgggggtgatgaggtagttgtgagaattaaatgagagactatgcaaattgttataatactccctggaaaatagttaaatacccaatagatagcatcactattttgaaatgctttcaaaattatactcgagttttacttctgcaaaatcaaggcagctttcttcagaaaagagagaaatgaacttcacccctaaaatgtacttggagaattttagagggtcttttccaagttgttataaagcacttctgaagtgaatttgcccatttctgcccacaccaatcttataacattccaggaataaaatctgcactcgagtttaaaaataaaacgggtggaacaaactgaattagaagtccttggcagacatcccccccagcagaatgttctctcaattggtggtattgcaataaaagagatgtatattttttagtctgctcttcctccctgataatttcagccagttgtatttctctattctaaaaacctggtatgcttggatttaatctcaccactcctatctacgctcctgctcctacccccacacccatttcccccaaaaaaaccccacatctgcacagaccctccttcccaagaaaacatggaggcgggctgctctctgataccgtacatgtgcattccggactgtgctgaggaaggtcatagaaacatgagagggctctgctgttgtcagttgtaaagactgccaagaaagaacaacaaaaaaatctcaaatgcattcacatttctcccgcctcttttttcttctgtaaatattcaaccctttttagagaggcttttgataatgtgttatctcagcaaacaccacgaaccttggatgtacgcagtactccctaatcccataggaatgactcagtcaagagagttagatgaaatatggttggcaagattgggtggggaatcttgttactacacacacatacacacacacacacacgcgcacacacacacacacaccagcagcaccagccactgcacccctatcatcgccatagacattatgtaaaaactagacattctcctctcccttacacagtcagttgcatctttcccaaaaatggaaggggaaaaagctttctttggctgagccatatgcaaaaaatcatggaacatctgtgtaagtaacaacatacaacaagacaaattattggtggtaaaaggcaaagcccttgtttcaaaaacatgtctggaaatagtgtgtatacagaaccttcctttgtgctaattactcataataactgtcagctttgtgtaccacaggctgggctgttaataactagtggtcgcagtacggtgttctttttctttccctttctttttttttttttcctatccttccttccctctttcctgccttcttttcattgttgttgcacaaatcatatagccttattccaatagttgctggaagaccaaatcagagatgtgggggattcagggactcgcgacatcttggagtatactagtggataaatgccacttcacccctgatgtggccgtttccctccaacacttgtctaaggagtgcagggactttggggtccaagcaatgtatcagtaaacttcagaatttttttcctaacatttaactctattctcagtctcaacacccgccacaaaaataatgtcactccaggcaaatttagtcgcttacggattctgagtcttattgtgattttgcctgagtggcaagcttttcaggcacgtgtacttaaaaatgtgatgtggtagaatttgcctccagctaggaatccacagacttgggtttgagctccacgtcccacagtcaccacgtgatcttcagaaaagaatcactgaactgcctgtgcctccatgcccccgtttgtcaagagggaggtggtaatacctgctgcggtttttatgtggatcgaatgggcctaaaactcatagaaacacagaatgcttctatgataagagaaaactccagccaggctcagtggctcacacctgtaatctcagcattttgggaggccgagatgggtggatcacctgaggccaggagtttgagaccagcctggccaacatggcaaaaccctatctctactaaaaatacaaaaattagccaggcgtggtggtgggcacctgtaatcccagctacttgggaggctaaggcatgagaatcacttgaacctgggaggcggaggttgcagtcagctgagatcgtaccactgcactccagcctggaggagactctttctcaaaaaaaaaaaaaaaaaacgaacaaaaaatactctgatgctattgctactggttgtttttttttttaatgctaaaaggactccaaacatcctgttatcacccactgtcaaatttctgcatatattttgcagtgccagtgagaaacttggggtctctacagtcagtaaggaaaaaggagtttgaaagaactaagggatctctgtctatggggaagaaatagtagggcagagaatttaaatttagggttcttaggaaatgatgcaccagggccaccgcacagccctcatgtctcctctcttcagtgtcctctctgcctccatcacctagtgaggagggaacaggtgcaggaacaggtcgccagggtgtccagcaggtgacctcccacccccctaccctcgccgcccccactgctccactggcagcctatgtcccaaccaaaccttacttcacattgtaattctaatgttctgtgcgtgttcatcgccatatttccctccatctgacccagcccgtcaaaatccttcctctacttcagggcccagctcccatcccctcttccgcaaagccttctaaccgcaaacccattaacctctccccacttggggcttctgagtccctttattatttatggttaggagaaagcatcacgtcggtctggtgatgtgtagtgagttgtgtgaatgtgttagcagagcagggtggccctgcatgtgatggttgggtgttagctggagtgagccagcctgggttcaaatctccctctggcatcagcttgtgctgtaattggggtaagtgctgaaactctccctgtctcctttcctcatttgcaaacttggcttaataatgatagctacctcaaaaagttgttgtgataattaaatgaatgtcaagctcttggaacagtgcaagcgcttaagaaatattatgttggtgcaaaagtaattgtgattttgccattactttcaatggcaaaaaccacaattacttttgcaccaacccagtatttgctattactagtcctggtcagctgagcatggtggctcatgtctataatctcaacactttgggaggccgaggcaggtggatcgcctgaggtcaggagtttgagaccagcctggccaacatggtgaaaccccgtcgcaactaaaaacacaaaaatgtgctgggcatggtggtgagcgcctgtaatccctactactccagaggctgaggcaggagaatcacttgaacctgggagccagaggttgcagtgagccgagattgccccattgcactccagcctgggtgacaagagcaaaactacatctcagaaaaaaaaaaaaaaaggcctggtctaccagagacaagaggccatgtcttgtccatgaaagccttgcaaccatattttacagatagaaaagacccagtccatgaacattaaagtcagtatcaggtacatttatcaacataaaatctgttcctttgaatcagctcaataataaaagagtgcagctgagcaccccctcccacagccccatgcctctagtcactgaaaatctgtgaggaatttttatagagtgtttcagaacagagcatttcaagacaaccctagagccctatggaatacattttcaatcatctttctgcgtctgctttcttttttgggtgcacacagcagacactggtgatgaggcatgtgcctgtgtgcactgttgttttatagaagctgaatgaaagcctgggagttgtatctgcctgaaaacttccatcctggcttctagagctcaacacctgaaacgctggaggcagttgaggtcactttgaaaacggaacccttgatgttctgctcaaactttagaggcatttacaacaaatcaggcaaatgaaagtgtggaaaaatcagaaacgaggaccactctgtcttagggattttgtcattgtatcgtgtgtgtgtttatgaatgtgagtgtgtgtcacatgtgagtgcatttaaccttcatgcaataagagagtagttttccacttagaaccagccaactctctataaaatttacctccgtgattctaattttgctccctccgccgtgggcaagttggcaatgtctgaatgtctgaagtcatttttgcttgtcacgactggggaggagctaccagcatctagtgagtagaagtgaggaatgctgctaaacatcctgcaacacacaggacagcccccaccacaaagaatcatccagcacaagatgtcaacagtgccaaggctgagaaaccctggtttaccttaaccttaaaagaacaattcgaatgcttgggaagggatgtctgccacatctgtactggagagaagcatggcccccagtcaaggacatggagagttccatgtctggatctagaccgtgtccatccacaaagatgcctcctgctcttctccgacatacaatctggtccatgagaatagactttattggtgagggggcggggctttaggtgagcggcattgaagggcttgttctgagcttggcctctgctggcagattattttctggccactttaatctcgatcctgcctctacttggtctttttttttttttctttcccccagtttttggatcttatagttccacaggacaagatacatctaagagatgggggaaaaggttaaagcagcaaggggatgctggatagagggggagggaaacaagaaaggaaaaaacaagacagagagacagagatagacagagatgtacaaatgggggctgcttggttaaagtgtcctggagttttcagcaagagattttgctgccagtgtctctccatccttctctctgcctctctctctctctctcacacacacacacatacagacacacacacacacacactcggccccaccaccacacacaggccaggtggctctgcttacatacatggcttggcgcttttactccttggctaagaccatttcacacatgaacaacacagcctcctcctagagatttgtcatccatctgcttgcagaagagctgtctgtttccctctgaaaattggtccaatcaacattttcctttggccagggtagcttaccagcagctcctccataaggtccataattgcaatttctcattctcatttgcctggctggcttcacccttctgtcctctctgcaccttcccacaagtgccccaccctccccaccagccctctcctccttttgtgttaataagccctgtcaaaatgaatgacagaatcaacttccttctcccaaaatggctcattactcataaatttcaagcaatattgccttctgtcctcaaaaggtttgcagatttttttcccccaactgatcccctttccagagtgaaatagcggatgaatgccttgcctagcaccctctctaagctctgcctctgtggcagtattgtgggccaatatgccaacgagtctttccttgtgatctgctccagcctgtcttgtgccatatgcttgtggcagacagtggttaatatcagtctgtgagcatcttgaggctagctttgaagtctaattctaatgtcatcatgcttatagggtgcacactttgtttgttctggaacagagggtcatctgctacgggatgtggaacactgaccctgatattgcagccgtgtttgtggttgagtgagggagcaggtgatgggcataggagggaaccaagccctgagccgtgtttcagggatgctcggtcccatcccctttctcccagatgacttcttattcttaaattttgaatagtgagtaacacaagcaggaggtgggatagcatgagaacttaggaaatcttcccatctctttgttacttacaagataaatgtctatactgaagctttagggacccagattacaactgaattgttttataaatgcgtctgaaatctgctgttttgaaggacaaagtaatacctgaagaatgattaagaaggcttagagaatccgcaggctccaaggtgtgtgaataatacctttccatggttcactaccaggtgatctggacctacagccagtcttctgtgtttcagtatattatgttgggagcattcccagacagttaatgcgtaaaatgctattcaaattctcctttaccgaaaggcattttaaagtaatacacgtgggtgaggaatacaagtgcctggtgggatacttttggtaaacaacgtggcacagtgggatggagtagggtctactttttcccaaatgtgaagttagtagctacagaggggtcctgagacagaaagcatttgtaaatattaatttgtgctctgtttcacagaatctgaaatcaggcatctgtgcactttaaaatatgaaagaactaagagatctagtgtttggtagcattttagagggaaaaaaggccatagctcaaatattgctctgatttcagttggctgaatttatgtgtaaagggcatgttagggaatagtctgcaaaggtaccagaaactgccattcatggaaggccctgagtgcaaaatgcagcagtcagtagttctgacccatgccattagatggttctggaaggtcctcagaggagacgcaacaccaacagtgacactgcttccagctcaggcaggctggagctgttctgagtcttcctgaaggttctgaatggtccagcccttggactcccttcagagagtcatggagcacccacatttcctttgcacctgaaacacttctttgtttctgtcttcaccctgactcctcatctattcagagatcccagctgatcctctctttcaaagccaggccagtgagctcttacagaagcttacttcagcattccttccaccgtcttctgagtagcagggcagacagagacagcaatggagaattccagttgattccccataaaatggccactttgttgtggggcatgagctggtctgtacttgtttgtgcctggcagtgcacacactagaaccctgggcaaccctggatgtaaatcaactagatactattattaaatagccgaaggtttgccagtgcagcctggagcaaagagagaggggtaaaatcaggctcccaacagacttccccataggaaacctctcctctgctgtgattttccagatgagctgcgtaaatggctccaaatcaccgaatgtttgtgcacgcaggctccattcatgcgcatgcacacacccggcttgtgtccttcttccctctcgtcccttgaacccgtagctcttgattctgcctgtaggagcaatgatgttgtagcaaccatgacaaaagaaacaaaatcagaaggcagatccaggccgctccctgccacctgccctctgtctaccttagacagatcacttaggcccactgggtcttgataagacatggtcttttcacacctgttcttccagtcttataggattacctggaggatcatgtgatgcgaaggatgtaaaagtgctccaaggggttaaaaggactttatataataaattcctacaaactgctataggcacagccatagctctgaaactagcattctcgtaaggctagtccaatccataagtttcgtttgcttcaagcagctcagatagacactctctgaagataaatgatgcataaaaacaccattgtttgtgatcagaataatcaggtaccactaaatagtcctgcatgtgtatgcatgataccagcagcctccaacttgcttctccaggagcactgtacttaacttggaaacccctttatttaatttctgtccactcacaaagcttcaccttgtcttctctcctctctgtcctcccgaggttaatccttgagagcctgtaatcaaggctaggccctgcccaccttaagtcaccctcccctctctctaggcctccacctcactggggagcgtcattgcagccagtggcaagaagctgcaaaattctctcatctgtgaagagagcccctaaaaccccaaatcccggaccagtagaggaaaccattgctgccctaatatcacatgttacaagtcttcgagcccatggtatctgagatgttaggagctagcattccttgtaattaaacccctggaacatcacaaggacccagttcagggggcttggttggttgactgattgatgacagcatctcaattatgtaggagatttctgtaaagaggagtgactggaaggaaaagaagataaccttcatttatatcatgagaccttgcgtagtagaaggccgtgaggatgggaacaaagtgaaatcatgaaaaacagcctgatgcaaaatgacaaagaagaatttcagggtcgttgagatcacacttgaacaataactgaacagagccagcactacagttttcagacctgatggctaacaagtgaaatgtattcagagagaggtgtgtgattataaagactccccctacccctggtgctctattccactgactgtccctttatgaaaaatgaattctagagttccctttctgaaatttcttacctgaatcagatcagatatgacaattctattttttaaagcaccttactgaaaataaagtgcttttcagtagtaaacctttaagattcctggtttccctctgacttgtgaaaatatgaaagaactgaaattagaccacattggcccaggttgggaaaacagatggcagagataaggcagatcaaagaaacatctctctgtgggtgaaggagttcctggttgtcatgtatccattttttgtagcgttttccctacttgaggaggctgttgtgaagggcaggattcttcactgaatctttattgtaaaaggcataggtgtgtcttgggtggattccagttctcaggttgatttgcttgacaactcttaggaaggaacaattaatactgctgcccctcaactagctagggagatttcactgtggaggtagaagtcggattcactgaggcagaattgccagggcttgagacccttcatgcctctcttttccaagtctctctctccaagaaagggtgaacttttcaagtcaaagagcagggacgtaaataaatgcagttatggctgtcttaggaggatccattcacttaaggcaaaggtcttagaagttacagaagaggagagagaatgggaactactgtggcaccaggatgtctggagaagagaaagtgcgcttactgtgcacagcttcctctccctcacctgcgccacggtgaacccacctatatctttctgctggcaaaaacatttgctcagtgtgtcgccggagtacttgagtgtctgatatttctcaaggcagaatctacctcactgtctctgaaacctcaaaatatgtggccctctcgaaggataacagttggcagcaacctaaggctgttctgctccaacttggaatgaagaggaatatgatttggccattcttcttagcacagaggcaaataaaaaaaaaaacccttatatacttcaaaagatgaagatcttacttcttactggctatctttgcaccaggtcctgggattggcatataataaaaaatgcatatgcagtggccatgaaatgggcttaaaggtcaatcttggctgccagtcgtggctaaactgcattgtattccatgtttttttccatattgcccctgcagtgtacatatacatgcacagtcatggcccctgcacactgtgtacacactcacgcctgcacacatgtatgcatatcaacgcctgcacatgtacttgtatgcacactcacccacacatgtgcatttgtgtgcactcacttctgcacacctatttgcatgcacgctcatctcccacaaatatgtatgcatgcacactcacgccccccccaccctcccgtgtgaaactctgcacctgcttgtctttaccctcacccttgaacctgtgtataacctcataaagtaggaagaagcccagtgttgaactctacagccttttacattcaaaatggttttgaaaaatgcccattcagaggaacaggaaagcaccaaacctaaaaggtctgaggacctttccatgctttctgtctcctaatctcagagctgtaccaatctgttatttaaaaattagtcattatttatccaaggcaggaggggacaaatgtaactgttagttcagtaaatgatttcattcttttttttttcctgtgtcctttctactgttaaagtgacgaaaatgacaccacggtttgatatgtggggttggtttcagtttgaataatctcatccttagctgcatgtgaactcatgtcttctcacactctattagataaaagcctaaaacaggaaggccagaaacaactgtttttaaaaagctcatgctaccctggcaacttaagttggaagaacctaataaataaatacaaagctgcccctctgtcctaatgtacttcttctgaattccagctgggcacctcatggtttcatgcctgaatcacaaaggcgagtgccagtacccagccagagcagttttcctaccataaaccagtaaatgtgtgtgtatcacatgtaagtcagggtcagatggggaaaatcaactacaaaaccgcagagacattatgcaaaattggattacgtacatgttttcagttttgtctcttagcagtttaagtctttaattaaaatacacacgagagagagagacagagagagagagagagaatctgtaactgttagattttataggccccggttatgagataatagccttccaagtaatttttatgggtcattctatctagtggcaacttagactataaagccatctcccagcttcccaaaagtaatgtctgttttctcactttctaataattacttcagatttgaaagtaaggagttgtcacagtgaatacaaattagagtcagcttcagggtattactaaatgtggattgttttgttccgagttttatccattttaggcagagtaacatgatcatttatatacatctgcctctatgcaggctgtgtagacatactcagaacaccagcttcacctcttcagtcttctaagacagtctttctaatactctatattgtctaatagctaagctattgttaaataaaaacacgcaaatgtttgcagttaggctcccccctccattctcaacctcttaagtgatacagacagtaaatgcattttgatgtttatttagaaagttggcatcctgggactgttcacaagatagctaatttgtctgaaggtccccagagacagtgaaagtcatcccaccatctctctagctgccctcataccggggaagtaaaatgcagcatagaacactgcagctcacgttatggagaacagtggtgctatggtgatttcctttctattcaaatcatttagtgaggatttacataatttgcattaacgtgtgactttcgatcacttatgctgcagcagagtattcgttgcctatgttctctaaggcaccagtgtggtggttcatgtgtccttgtataaaagattactgtcctccccatccccagtctttgtatctgtgcaccagaacaaaatgccctcggatcatggccacccaggccagagaatgaggacccacactttaaaaaccctgtagatgataggatgagcggtcctcatccgtcccctccctgagagtgaggttgggttggagtagaaggatggactctgccaaatgatgacagcagccctgagagtccttctcacaggtggccagctctgtcccctccagcctcaccacacattcccctagtacacaaaggcagacccgggcagccactcagcatgcacatgtagcagtgtcccctgtacactggtaccctcaaggcctccctggcacctttgcttgttacgttggctgatttcttcaaagggaaatatgggatgtggtgcagcctggccctcacacactctgaaaatagcactgcccagggccaggccttttcctttgcacactgccatacccaccctggaaagtactccatggttgtatcacaagaaaacagccatttgggcattttaaattactcaaaatattataaaaatatttataaaatatattaatgtatatatttataaaatacaaagagtatatgattaccaggcaaatgagtagacagtgatagaactatcataagaataggattggctattaattataataatgattggaatagataacatttattgaacatgtattatgtgccaagcactgtgctaaaatatttacatgcagcagttcatcaaaagctcatgggaagccatgtgcagtgtcatgcacctgtactcccagctacttgggtggctgaggcaggaggatcacttgagccccagagtttgagcctagcctaggcaacatagcaagaacccatctcaaagaagaaaacaatacaaaaagctcatgacagttgtaagacatatgtaccatcattacccttattcaacagaaaaggaaattggggcttagggtgggtggttaccttacttgtacaaagtcacacagctagtaagtggaggagttggttcaatgaaggataaccagggaagcatctgtgggcatatcgaggcctgaaaataggaacaccttggccaaatttcagaccatgacatcaagcgaatgcttgaaagctaaggaacaaatagaaatatgttgtatcatttataacaaattgttaccattaacacctacaattattagcgttaggagtattgcggtgggaattgaacaatgagaacacatggacacaggaaggggaacatcacactctggggactgttgtggggtggggggaggggggaggggggagggacagcattaggagatatacctaatgctaaatgacgagttaatgggtgcagcacaccagcatggcacatgtatacatatgcaactaacctgcacattgtgcacatgtaacctaaaacttaaagtataataataataaaataaaataaaaaaaaggagtattgcatggtcagactgttcagatctcatgaatgctccctgcttctctattccttctttgatttgacatgtgccaggccatgtattccagtggatttctgtactttctactttattccaaaggctaagcattcctgaaagccacagagggagttgatgtgcttaaggaaagaagtatcgcttaatgtggccaaaaaccgattccatttctgtacaaatgcaaggagtttttgccaggagccagggattaatagtctagaggaagggactaattgtacacaggaacaatatttacttttataatgggaatagtttgagacagtgcatcttctagacacaaacattcagtaggaagggttatgcattaattctttcatttaatgagcattttaagcacctattatgtgccaaatatcttttcgtagctctacaacagtgttcacttctcaatcttttgctacaccagagcgttgggaccatgctcccattaatcaccctgtctcaaacaacatgctttaccttcattcgttgatttactcatccattccttctcatagtttttaacctcaagagctctgaggttcagggtggaataatatggagggcctttgagaggctaacttttgaaccaaatcttcgaggatgaactagggtagtggcaggtagaaaactgcctttatatttagccttctttggtacctggtcatggatttcttcttcaagcatgaatggcatcagttgtctgggagtgagatacagtgttcgtatgctgagaaacagattaggccattaaaaaaaaagttgtggccacgtgtggtggctcacgcctatagtcccagcactttgggaggccgaggcagggggatcacgaggtcaggagatcgagaccatcctggctaatatggcgaaaccccgtctctagtaaatatacaaaaaattagccaggtatggtggtgggcgcctgtagtcctagctactcgggaggctgaggcaggacaatcgcttgaacctgggaggcggagcttgcagtgagccgagatcgtgccactgctctccagcctgggtgacagagcaagactccgtctcaagaaaaaaaaaaaataagaaacttgtaactccctctctctacttgatgaagtagacatcaggaaagactttcttattctgctttccattaaaagccataacttggaaattattattgattgggcttggtgtggtggcttgcgcctgtaatcccagtgacttgggaggctgaggcaggaggattgcctaaggtcagaagttaaagaccagcctgggcaacatagtgagaccctgtctcaaaagaaaatttttttttaagtagcctagcatggtgatgcatacctgtagtcccaggtactggggaagctgaggtgggagaatcacttgagcccagcagttcaaggctgcagtgatctatgattacaccactgccctccagcctcggcaacagagcaaaacctcatctctaaaaaataaataaaataatatcttaggggaagttgacaaaacattagaaatattgtagggttaggtgcctgttgagccccaggatttattccattattcactcatatcttcatgtatccattcaataaatacttattaaaagcctacaccatgcaagataaaagccacattctactgagtatgcaatgatacacggtatggggtttctgctttatggaaactaaaggcctactagaggaattcaggaattccagtgtgtaccagctcggctgtaacacagtgaggaagagataggaaccatgaactaagcggtgaaaatgtgatgggattcagaggggtcagaggtattggatacagtgagattattttaaacgtttagggtgtacgagcaagatgagtaggagatttctttaggaaacatctccctatgaaataaaagtttatataaaaggaataataattacagttgatatttatgaatacttaatctgggccagggactatacttagtacttttcatgcattgtctgattaggtcctcacaacagccctgtaaggcaggtattgtactttcttatattttatagtttgcactattgtgtgctccatggttatagcaaaagctttgtctgtaaaaggccacagggatagaaggcagagaggaaagtagatgtgtgatgcagtattaattattgagccaataaaatctctctaatttagattttttaggaggaagtcattttacattttacattaatttaatctatattgagagatccttctaagaaaataagttgcattacttcaagtatacatagccatataaattattgaccaattttttttttccaattcatagacattactttccagaaactagataatgaccatttgttatcagcacactgactgcaaaatggatgatgaagaaagcctgggttttttttttttttttttgaaagcttggtagttcttcttgtgaataaattaaacactttcctgacgatcctgtttgcattattgacttatatgtactggctcatatgtagctgcccatgtataattctccccactcattctgaagggagggaaaaaaacgattaaaaatttcccctccttctttttcctgttttgagattatttttgctcccagcagaggcgcggaggagggagctctcagagccccattctgttccctacctacagcatgaaggatccagataaccgcagaatgaatgaggtttgagcatttgtttttgctataagtaagatggtttcccattaataaaagtggcactcagtttactttgtcttcgccagacaggcaaagggtaaattaaggtggttacctgtggtgtcccagctctttcccaaggctggactagtgtgagccgagaaccaggcaggactcactcacaggtccctttctctgctacttctgctctggttttatgcgaagccctatttcccagctgcttcgggtaaacaaggacttctgtgttgaaataataaccacttgggctgggcgcggtggctcacgcctgtaatcccagcactttgggaggccaaggagggtggagcatctgaggtcaggagttcgagaccatcctggccaacatggccaaaccccatctctcctaaaaatacaaaaaattagccgggcatggtggcaggtgccgtagttccagctactcgggaggctgaggcaggagaatctcttgaacccaggaggcagaggttgcagtgagccgagatcgcaccatttcactccagtctgggcgacagagtgagaccctgtctcaaaaaaaccaaaaacaaacaaacaaaaaaaccacttattgtttcactgcctaatattaattaattggccaaatttctattttattatattccatatattttaaaataatttcttcttctgttgtacaaaccaagatagaagataatttgcccaagaacacaattggtaggtatcctagctaggaaagtgggtgcttctgaaaattataaaaatgaaatgaggtaattttctgggcccttggtacaatgcctgagatgtcatatatactcagctaattataagtgacattttgttctagaatccagtagctcaacttttagtccattgtgctgaacacaaatctatagatccttaaattgtatacttttattaatttaattttaaagagccagaaaaattgactacattggaaacattccagtccaccaacatattgagtagaaagaaggacaaaggccatattctctttcagatgctacaaattgtgtatattttcagtaagctgtgtctgcttaaggaggcattactgcattcggatagataaactcaaataaaaaggcctgagtgaagaggctctactgggtttagcgtttttttgttgttgttgttcagttttgcatgtgtgtttttaaatcagtttatggttcataagctgatgaagcagtgagtacaagtttgaactatgagaagcaggtttgaataagtctagacatttggttatcttctgtctagcattcatttgtgtcgtgggcgtcacactctggggattagtgtttcattatgcagaagctgttttatctttagctttcttataatagcttaaagtgaattctgagtggagagagaatgaaggccaggccttagtaactgcaagaatcataccaaaatgggttggatgggttttaacagtgaccgataagcattacgacctcactctctgatagttcagttggctcgatgctgtctcatcacctcatttagggtacaatatgctgaggaactgaccaaaggtccctgaacagtgagagatagggaagagcagaaatccgttcctgtaccaagtgtctaacacttaatataggtgagagctggcgtgagattatctgtgctgtggaaaaatgaggacctatcgatacctctaagtatataatcactgccgtgtcacattttaattagctccttgaggctatagaaagaagttcgcttcttatcctccaaattaagcatcacttttacaaacaatcaatgttccattttcaaaaccccaagtagagcaatgtttgattttccttactttccagctttgagaatgtttcatttttagaaatatgttataggaatgtaaagtaactcttgtttccccaaataaccacctccttattatctgttcccctaagctgaatcctttcaaaggaaattttgtcttcaggctaagtttagtggctgatggaaatcaaaattatatcaggtgggccattgcgtcagtaaaaaagcccagaccaccaccacacaggatttttctccagacacccaaacatcatgtcacaaagctcaaaaaagtagtgattaacatgcagtgctttcaggaggcccacattgccgattcagtcccagtatgggctcgtcagtttcactttcattcattcatttatttatttattcccccacccattgattcacattcactcatccattcattaaacatttgctgcacacaatatcactgttagacagactttcagaaatgattgggttcctgtattacagacatgagcccacggcacaaaggtcaaactaagagtaagatggatgtttatagcacaagcctataacaaaaagaatgggtcccgagccgcatcttcttccaaatgcacaaactatatttgtaccttaaaaaaaaaacaaaaacagtgtttccttttgagaggcagcatggtatatgggaagaacacggatttaagaactagacaggcctgggtttgaattctgcatccataatgtgctaactgtatcatttcgaggaagttcttttgagtttcagtttgtctttaaatagagtcatcatttctactttgtagggttgtgtgaggattaaatataaaatatgcagcataatgactggcacatttaaacgaagtgctcagcaagtgctatttcccttcccctttcttcatttctaacatagtttgggaatggtttaggatgactctttttcttcttgtgaatagatagagacctcatcaccctaacactagaaaactataggacagagaccatacttcttgctgtggccagccctcatccactttgatgatgcttgcagctcccaagagagacaacagcccccacggcatggccaagagaggagcaaactctctccccaaggcagtcactctggggatgccattgttccattgccaaactcatgacctttggggaatttggaaatctactactttgtggggagaaaaggacaaagaaagtcaagattaagctttatatgtaaaggccttttattttaatggtgttgaattgagtttggattttgcgtacccttcaaatttcttagggtgtgggtgagggcatcctaggagatttaattagctccttgagcggcactgaagtttgcgacattgaggcacattttcttctattgtccattgaagtgggggagcctggcaatgaaatttctgagaaactgacgctgttgccgtggatagaattgtatggatatttgaatttagtttagtcacttggtggagttttattttgttgtttggtttcttttggaaagagaaaattagtatagtatgaatctgagcagtctggttacatgctttaatgggcctctgagataaagcagaaaaggatgtagtctagtagtaaccctttagatgataagggacacgcaggaggctgtccaagacagtctgttaatcttaatagtctctcacttgttaagacctgatttatttcaaactaaatttcttgttttgagtttccgggtgaaagttctggactgaatccctaaaaacatgcacaacaaagaagaaggcttttagaaaggtttctcctattgacagggttcatattctatagttcacaattcagtgaatcaacatttatattaatttcatccgttacaacctcagaatttgcctacaagatccaatggcatttttactgcccttatttagcaagcctatacagtacttcatgcacttggtcatgtcttcaactaatatttattgggtgtcttccctaagcaagatagtgcgagagagagagctgagttaaaacattcaagataacctcaagaagctgacaatctactaagggagataagacatacatattaataagaacaacttaaacacaaaggacaagatgatatgtggcatatcttatcaattaaataatgttggacttcagagggtgaaggaattaggcatgaaggtatatctcaacagggctgtgaatgactggaaacaaggtcttctctcttcacactgtgagccagccacatccatactacggtgacattcatttctcccccaggccagctatgggcagaagtttaattatccttgaacgtcttcaatgatcctcatctttgcccttgttccctctttatcctttctttctccccaatgtcttaaatcctgatgcagccagggagattttttttttttaaccttcaagaaggtaaaaaactatgccagggcaaaatgccagatcaatgttgctattaatataatcagatataaactttttccagttggcaccaacaaccctgggccttctctgagtaccacctataaacagggcttcaatttcccatttttgcatacttactaatgtactacagatcttgcactgactttaattcaatatcaatattaaagtcatatgaggtagtagtaaatagagatagccataccttagagtcaataagacataaaattagttatgttattattattattaattatgcataatatgtcattttcctgaagagaacagactaatagctgatttcagcaagcatctttaggcttttgttttcaaattattttacatctttttcttttcttttcttttcttttttttttttttttttttgacacagaggtctcactctgtcacccaggctggagtgccgtggtgtgatctcagctcactgcaacctccgcctcccaggttcaagcaattctcctgcctcagcctcccaagtagctgaaactacaggcatgtgctactacacacggctaatttttgtatttttggtagagacgtggtttcagcatgttggccaggatggtctcaaactcctggcctcaagtgatccgcctgcattggcctcccaaagagctgggattacaggcgtgagccactgtgcctggccacccacctattttccatctttagcactggccgttctcattcaaaatacgtactgctacactaagaggagacttaacttcaaattcactttgctccacggatgttgtatatgacctgaatagatgtaattctgacaagcttgtagttcattggaggctcacaatttgaaagaaatgcatgattaagactttagaacataaagaagattctagtaaaacaaatgattgcacccttttggattttttgcatattatctttatgtagggaagggaatgatatgttagaaagaatcctcaaacaggtttagacaaatcactggttgaaccataatctccaaaatatcgctacatcagaaaaagcccaacatagcctctgaggtattcgtcagaaatcccagtgcaagcattaggaaagaaatgtactccctgctcctcacctttgtaagtcagatttagtcttcactgttcatttcaggttctctgcctccataggggtcccttcagcacttgtttggttctctaattggcttatgatagtgggtcttacatcatcaactggattgtaaattccttcagaaagagatgtcaattaagtacacagcagagtcacagtatttcaaaattggaagtcatagtaagggggaaggagggccgctagatgctgtgattcacacggcgtcatagtaagcaagaggccgaggcagtgccagcacccaggtagggctccggtgccaccctctgcttcatcctctgccaagcctatcacgacggtcgttcagctcatgctctccatgcacgtctggtgatttgatgctcatctttgccagcttcagagcatcactggacacatgcccagtcttgaagggttaattttcaagtaccaagcatgctttggacaaactcaaatctgttccttgttttcgctcaacccgcaaccagcatcatcagcccagacgcagcttccccagaaggccagcaggtggagcacagttttgtggaacttctctagaactcgctgtttaaaagccgcaaaccaagacatgtgaggctgtggggtggggggcaaagaagagccccagattctgcacgtctggaagcttttaaaattgtcttacaacaattttagacctacaaaagccagcttttgaaattgcataaacggcaagtcgagttcttttttttttttttttttgagacctagtcttactctattgcccaggctggaatgcagtggcacgatcttagctcactgtagcctccacctcccaggttcaagctattcccctgcctcagcctcccgagtagctgagactacaggcgtgagccaccacgccaggttaatttttgtatttttagtagagacagtgtttcactatgttggccaggctggtcttgaactcctgaccttaagtgatccacctgcctctgcctcccaaagtgctttgattagaggcatgagccacggtgcctggccagcaagtcaaatttttaattagacttaaaatgttggtgctcataacaactacagttactgtggttttttttttttagtttcataaagaggacagacgctaaggcaattgtgtggaacagagcagcttctcggggtaaccatctcctgctgatgtataaatatcggggcaaaactgagtaagttttagaaaataaatgtcaaagcaagtccgagtcatttattccttagcaggaaatatcgatcctgtgacattatttgattataatgactgtttctattaggttaaatgactgaggtatacttaaccagtttaggtgaagaatgaggctcattgcaccatttgattgactaaaccttagaacccatgtattctttttatttgttcagtcaccaatttttatgaagcacctactgtgtgccaaacaccctcttgggtgccaaggtaagaattaaattttggaattaagcaaagcatgatggctcatccatgtagtcccagctactcagcagactgagacaggaggatcgcttgaacccaggagattgaggctgcagtgagctaagaacatgccactaccctccagcctggatgacagagacctcaactctaaaaaacaggttttttaaaattggaattaaacacacttgggttcaagttctacttcagctacttattagttgtgagaaaataaatgtcaaatgtttttcaatttgcataagttatttaaccacattatccttactttccttatcattaaaaccctgaaaaggttgtaagtgacaaaatacgtgatacacacttagtgcctgtcagatgataggcctgagttactgttaacttttttttttttttttaccatcctcatcatgttcctcattctcatcttcttccagggttctcacttgatgaaggaaagtatttaagacaatacttctttaacatacttaataatggaatggatatagaaatgggagaaatcagtgtgaaagcaggctttggtgaggccactatttaaaataactatagtttatttaaaggagacacgaagtaactgagatttcacaaggccccagacccccttctcgaatgttattatcaactcccgtttctgccctgtgatgtcatgagggttgatgatcggttcttcttttattttgttgccaagtacagcagggatatgtgtcctctctattcctgagtggtgaaagttctcttctgagaccacaaaacatggtggcctcaggttctttatggccccacggtctcttcctgcacccctccccaaggggctgggttggtagatattcctaatgttatatcccctgttgttgacacccccatgcccccaatcccgcatgcctagcagatgcaccttaacccaaccactctgggtcagttccttcctcacacagcaagctgctaagaaggttgaagaattactggacttcagataccacatggcaccattatccctggcaggtttcctgtcactgcctgtttctttttcttccaggaggctcatcaaacaggcctccacacaaacagaacatccatccacttcacaggccacccagacgtatccagagatgcccagatgagacctgatttgcctgggttaaccgtgtgtctgcagctcagaccctccaatggggcttctagctacatagtctaatgatgaaaagctactggcctgggatttaagagcacagctttctagcctaactccacaactgtgcccctgggaattttagtctcctctctgcatttcaacttcaccaactaaataagtaccttttaatatctaattgaattgatatgctatataagcaaaccagatgttgtgagtaaaaccagcttcagcatccaaaagttgatacagatacttttgaggagcatgtttcaacatattccttaggacagccttactatgagaaggtcatctctcagtgatttcaatgtgccattggaagaagagcttctgccatttaaatgtccagttaggcactggtggacacagcagtatccttcccattcattccgaccatattattttgaatcataaaggcatatccttagaggagaacatttaaaaaatttaataatgtatttgtttcattaacatgaagttaagactttaagataagggtagtgcccacaacacaatcttttaaaatgaagccaagttaacagtcattactctgtgatctcaggcatgcccattatctctctgagctataacttcctcatggatgatcactagtctcctgccgctgtgaacttttacaaatctgattccatagtacacatcttaagtgttagaaatgcttgttctttggtgctgtaaagaaatagaccttgaacataaatttaatttcctcagcaagaccatttttactttctgcagaaagggtacacttgccagcagttttgccacaagagtacacggaacaaaggagacagggtcattataacctgacgcgtccaccctactgctatgtccagtttccattggctggaatgggacctcacattctgtatttgtcccgaatggctagcagcttagaactttttaaaagcagcaaaagcagaagagaacaaaggaaggaggaagtaacttgtgaaatgctgagaaaggtaaaaaaccttcaaataaggaagaggaacaggctatgacctaatgcttgcttggaccagtataagcatgctagggtaaatatttaggctaaattgtgggagctaagaacataaagtacattgatttctttattacagctagcagatatttaagaatgttagcacaggtctttgaataaattttgcttctaagagaaagtactattaattcctaattagatggggaggaaaatctttgaagaggaacctctactttactttttacattaaggaaatagggtgtctagtaatgccctcaaaagttatgaatgcccggtatccgttaggtttgaactaactgatcttcacattactttaaaaatagagatgactcaattattggttggctgtgagtaaaaccaaataaagctttatttaaagttttatttagattcttgaaaaaattatttaacttgggttctccttggtatgattaatttagagagaaaggaatctgagaatgctgttgacctcatcattccttcacatgttccacttttttagtctctcattttaacttaatgaaggaaagtcatagggagaaaaaagagagagaaaagaagataaggctgtgaagagagagggttgttttaagacctcacgttgaacaatcagctaaatctgcattgaaagcaagagaaatagctcaaacacaggtttatagtattttctttctgagagtgaacattgtgcagtaaaaggtccttcacatgctatggttcatacactggcatttcatgaagcagtagggagcagagttaaccccaccaagagcactgcagtgcggccttccttcccagcccccgttccagcacctctttccatttcccgacttttctttcaccgccagtaaatttaatgtcttcagctgagcactgatttcatgagcgtaaaggacattagcagtacttcgcacatggtatgcacaaatattaggcaagtccaaggacaggatgagctgcaagcagtctatgataagagtcaaaggcaggagttggggttgtagactcctccagccaaccacagcaaccaggaatttggatgcttcggccgccagagtgcttgcaagagttcatctctgaaatcgcttccattccagcgctaacattttatgaaacctgtgcttttcaaacagattgttttattgcttcctgcatcaccaatgtgttttctctttgctcccagctccctgagagcattttgaattatagcacagatcattgccatccacaaggtgcatgacatcacagtggacttgggggaagcaatgtcaaatgagactgagtggaatgggaaggagataggctggaaaatttaaataaaggtctttaggataaaatacagaatccagaatagttcctaactctcactacgtagtcgtttgtagcaaactgctaggactcttggcttttattggtgtgatatagatgcgctgctccttaatggtagagactgtgtctttaatcaaaagttggctacagagttgtttgtgcctgtgatatacttattagtccagagcagatatattttctgtcgtgtgtgctgaggagcactgatgtaaatccacttaatgttcatatcaaactctattctccaggaaaaggtgagggactgaaatgtacatacttgttggctggtcacatttgatattcagagacccaaatgagaaagtcttgcttctgagaaagtacccaaacaccaggacatcttccaagccccacacagtagcattaatgttttaggtgtgcaataaatagtgctgaatgaaggaagaaagtttcccaggctagaaacaggtgagtggagacgtgattattattaatacaaaatctggtgtgaggtgggggtgggaccctctccccaggctgtaccgacagccccttgctctcagtcggactcccaggctgagatccggccactaaagagggaacagtgacatttcacaggaaatgacccagaaaactaacaacgtggagtgtgtgtgcgtgtgtgcgcgcgcgcgagtgcgcgtgcatgtgcgtatggtgcacatgtggtgggggctggggacagcttgaatacaacccagggaccttaactggaggaaagactttaccaggcagactctggtaaaagtcgagcaggaagctgagcgtgacaggaaccccaagggtgtcaaaatgccccctcactcagcatctcttgagtcccatcaggacagaacttgtgcttagtcaggttctggacctgacagatgtgaaccagacgccctctcattgctgggggctctgggagggaaaggtgggatgaagagggcacattcctcccaaaggacaaagcaccttttagtggaaaatgtgaaaacaaaacatgctcagttcaaacaaggctcactttggtccagtacttcctttgttatgttcctgcctcttaaatctttctgctttaaagaactctccaagaaaatattttcagagtatacttttcagaggccctgtggaagccaagaataaatggcctccttttttgggtaaagagtcatatgtttaagatagttttatttgctccccccacctcctgccccgcatgcacacacgttgatatggttaactatcttctgctctgaatcagtattaagaatgggcacagagatgactaaaagccagaatttaccatattatcccacaaagcagtaacttttcaattttaggatacataatttcagcatttttcctatcactagatgtttagagctccctccagtgtctctatattgtcatatttactttgagatttttttttttcccaaagatcctaagaattcttttaaccatagcagggagagtatgttattgtctttaagcttacttcaagaacagaacgtgaaagccagaaatatcacatgcagccccacaacctatagattgtccattcctgctgtctgtgctttttttcaggatgaggagagttttggaggtagaagaagatgaagtggtcagaggatgggactcaggaggggacagggtaataaatatggtatgaaagttgctgcatttaaagagcttagggccgggcgccatggctcacgcctgtaatcctagcacttttggaggccaaggtgtgaggatcacttgagctcaagagttcgagaccagcctggccaatgtggcgaaaccccatctctactaaaaatacaaaaattagtcaggtgtattggcatgcatctgtagtcccaactacttaaggggctgaagcaggagaattgcttgaacccagaaggtcaaggctgaagtgagctgagattacaccactgcactccaacctgagtgacaaagtgagaccctgtcttaaaaaatttttttttaaagagcttgaataacttcctcttcttagaaaacgcataaactctgatgtgtcagctgagaagccgaggacctgggatttcaacctcttgcccgtgtgtttgtgattctggcgtgaaggtgatgatgcatttccaaagttgaacttggtctgctaggtttgggatgtggcagaattctggttcctgccagagtcccagtctttctgagtgtatgtgtgtgtacatgtgtgtgcatgtgtgacgtatgtatttatatccatacatacatacacgtgcacatctacatgtgtatgtatatataatcaagatgttcaaaattcaaagcgctgttttaagagagttaaaaaaaattcactatctacagatttgaattcagactgggttaaaaccaccttcctcctctggttgtcaagaggaaggttttggagttcgtgaattttttctgtggagttaagataacgtttgatgtaggagagcaaagctgcttcccatgcctaattccataaaaagcccagaacctctgaggcccatcttcagccaagcagccttgccctctggccttttctgcaacagtgagacaacagccctgggcacagcgggagttggttctgacaccagatgttctctgctcctggttaatgtcagtgagggctggaagttgaataaatgagaacaggagtggtctgggcccatgtaaatgatcctcccttgaaaggaggaacagctttcatcatttgttccagctaagccttgcatgcattatagatctggtgctaagcagtgggaaagatctcataagtaatgttttatgttctttctgtctctcctcttctgttgttcttggcttgtgggttgtgttcgtgttgttaactggaaaattgctataagccagttgtctcgtaagttttaaaaacgaattagaaaaaccataaaatcctctggcctatgcacattgtccctgttttgtgaaaacattaaagggtaaataaaaaggaaggagaacagtcaataatgtgcatcaaatatattctgagttctagagaaattaatgaccaagcattagaactagaagcaaaaaaaaaaaaaaaaaaaaaaaaaaaaaaaaaaaaaactgtcagtggttggcgagaagtcttgttttttccagccatatagatcaactgatgatatggtttggctgtgtccctgcccagatttcatcttgacctcccatgtgtgtgggagggacctggtgggaggtattgaatcatggggggcaggtctttcccatgctgttctcgtggtaatggataagtctcacgagatctgatggttttaaaaagaggcattcccctgcataagctctctctcattttttgcctgccaccatccatgtaagatgtgacttgctcctccttgccttccaccatgattgagaggcttcctcagccatgtggaactgtaagtccaattaaacctctttcttttgtaaattgctcagtctcgggtatgtctttatcaacagcataaaaatggactaatacgactggtggttgagaaaatgtagcagcctgagatttaagaaacaagtgatccctgagacagagcccttgaccctaaaggggaaaaatattcagttacactcatgagatataaacatagtacttttgttgtaactgctgagaactgaagagctaaaagtcaacattattttcctttttgagactcaaagtgtgtccaccaggagcactcttcccaatggaggcaaaatctgccaaagttgtttttgttgctgtctaaccttagaccatttcatctgccccaactaaaagtcctagccacagctctctcaagcgattctccaccctcagcctctgagtagctgggactgcaggcacatgtaccacacccagctattttttttaaatttttaaattatgttttttagagtcaagggtctcaccttgtttctccggctgatcttgacctcctggtgtcaagtgatcctcctgcctcagcttcccaaaacaccaggattacaggtgtgagcctggtcccccaggcttgacttggcacattgaatcttttatgaagaacaattaatgacttcccatgttgtgtaaagagacgggcaaatgtggcttcaaagcaagtcttgccaaccctcgctacaaccagactgtccctggcctaagcaagcccctcccatgtagacctggaaagccacttccaggtttcaaggatgagttttagaaaattaatggggtactagcatatgtgggtcaactctttattttaatgtaaggacactggacactttaaaataagttttctaatctttttaaaaaggaagggatattttaacatccccaaagtgaaaataatataatatcagagtaagtcctagaaatttaatattatggtacatttactatgttgtctttatttttcttcatttccacggattggccctggttctcagaccagcatgtgggaactactgggttggagtgttagccaataaaaatggccaaaaagtagaccatgaccttctttgagcttttctctggcttgtaattcccgaagctccttctagtgccaaaatacttctccctccctccctcttttagactgtaagctcattgagaacaaggacaatatggtaatcttaatatctttagcacacagtcagatatgaaagagacacatcataaatattggattaacaaatgaatgttctgaaggggaatgtggttgttgccactgtagaaaaggttcaggaaccaggaattcttgtgtaagatgtcatccacatagtcactggagaattccacagttgggttgagggcaaataggaatgccatgatccaggtacctagaactggcttgaaaacttgtaccttgcaacaataaatggaagccaatggccatgtggtctggccatggccacgtggtcagaagagaaggaattttcgaatgaggatagaggaagtagccacggagccctgaacaggggcttgggaggttgagctctctccacctcagagggctgtaggagaaacagggctgtctgcagggagccaaggttacagtctgggttggagagaatgttctgaggaaaggctgaagcaagaagagagctactttttactagattactgtgtattcagagggcagagtggaaataattaatactgagtgaatagaaggacagacagacctaaggataggtgagagaggtctgtctggtgcttctgaaagtttcaagtgtctaggaagcccccagcgttctagtggaaatgcacattctggttctgtcagtctgggtgggacctgagattctgcatttcccacatgctccctagtgatgctgatgctgctgggctgtgggccatggtgaggctagcgtttaggtcaaggaaacaagcatcttcagaggatgtcctccaggagcccaggcaacagttagaaggtcaatggaaaattctctggctgcagctgatcttttctgcttccctttagagcagggaatctcaacagcactgttgacatttggggcccagatcatcctatttggggaagcagggagatggagggggtggaggtgtcccgtgcattgggagaaatttagcagcattcctggcctctatgcgctggatgctggtagcacccggcagttgtgacaatcaaaaatgtcctcagacacttccaggtgtcccttgcagagcaaaattgcttccggttgagagccagagggttagaaggagaattatgtgtcttccctccccgcttgctgccacctccacctcttgtcttctagaaccatgaggcagaaatgacttaagtctgatatgcttggaacgcaacactcttttcgctatttctgtctttagaaatgttgagaaagtgtttgcctttatttgacggcctgattactttaaggtgtcctcggcatagaccagtgagcgccttggccctatttgctgacagttttaatagaacagcagggaaagtcctttccaagaaagtgttggctacgtagcctaacgtcattttaagtcatcaccatacacccaccaaacctctgagataaaatggaaactccatcatctcttgccagggtaatggtgttagtaattcactagtgacctctaagaatttctctgtgcattcactgccacatttaacttttgttacacggcctccaaaatgttttccagccacaaggtcagtccattgacaatctcaaaaatcctgacaaggggacagatgggtttagtttttgcctttgtgatggttagttctgcttaatgtgttgagaaaacatctgaaggttttaaccctggctggagtcgtgagacggaggcatgtttaatggaatagcacacgatcgtcctctcatggtgagtccacgttggagggcccaaagacccatgttgtacaatcggttcaactttttctgaaagccaaagaaaacctacctccaaacaggatttagtctcaagctagagcaaaaatgtacatcatgttgaaaagtcttctccaagtgctacaattcataagcagtgttgtgtttttactggaaaagcttgccatctagccaagcattcttcacatttttcccaggatttagtcataaaatcattttagacatattgcaaggataaaatgtgtacatatctgataaaaggcagggatttttttcttcttttttgctgtataactcctggaggaggcgaaaaacaaactagacacacacatacacactcacaaaacacacgtatttgtgcatatgtatgtgtatatagagagtgcacacatgttcatatatatacgtgtatatgtgtatgtatatagtttgttttccccctcatgaaatgtgtgtgtgtgtaaaataaactctatacacatatacatatatattattttcaccattaagtgcaagaacttggattctttattcacgattacttctatttgaatttaaattagatgccttaggcttctctttgggtttgaataacttagacacaaagtataaaacacttcctaatgatgcccacctgcctaggacatctttaggaattcaggtggaagtgtgtttgcatttgatttatctaagacgttgcagcagtggggatgtaatttctgcctttgggcaggaagggagcttagatggtggagttcgtatttgtaaacgtagatgtgggtgcctcaaagttggctgcgttgctaactaaaggaaggagagaagtgagcccagatgttgaccttttgaaaaaaaagtcccattttcatgacagattggcataaaagcaataacctgtggtaaagtctaaagaatacaagatttggatttctggatttgagtcctgtctatgcaacttactagatatgtggccttggacagatcacctaatctcacctgtcaaacagggacaatgaaactcaacatagcaatggttgcgaggagttaatgaggtaatccgtcaaattctgtggccgtggtgaaggatgatacaaatatccagtggcgtttttgttcttgaagatagtattcttgtgtgagttcttgccaacacacatacaattacatttctgagtcagactgatttcagtagcagataaacagagggagtaaatcagcaatagattagttggaaactctggacagcaatgatttggtggcatatggcttggtggtatgtacctgcacatgtaatcatggaaagttgactattcctactgttctcccctagttctatttcacttaagaaaaagttggaatggataccagcagtgtgctgataaaagtttagctactactggcggccgggcacagtggcactttgagaggctgaggcaggcagatcacctgaggtcaggagtttgagaccagcctggccaacatagtgaaaccccatctctactaaaaatataaatactagccgggcatggtggtgggcacctgtaattccagctactcgggaggctgaagcaggagaatcacttggaggtggaggttgcagtgagccaagatcgtgccattgcactccagcctggatgacagaacgagacttcatctcaaaaaaacaaaaaacaaaaaaacaaaaaacaaaacaaaaagtttagctactggctcgggaataacaggacgtttgatttgtagcatttactgatttctgtaatataaatactctcactgtgactaatttcaaactaccaatgtgacattaccaaccatgagattgtaaagagatgcacagtagcacaccaccatataggacagtcgtgcatcacttaataatgggaatgcattctgagaaatgcatccttacatcgtccttctgcaaatatcataaagtgtgttcacccaagcctagatggtacagcctgctacacatctaagctatataatgcagcctgttgctcctaggatacaaacttggacatagggttacgattgcctacagcactcagcaccttactgtactgaatactgtaggcacttgtaacacaatgttcctaaacatagtttttgtgcatctagacatagaataggtacagtaaaaatgaagtagaaaagattttaaaagggcacacctatatagggcacttaccatgaatggagcttgcaggactggaagttgctctgggtgagtcagtgagtgggtggtgagtgaatgtgaaggcctaggacatcactgtatcactgtaccccactgtagactttataaggactgtacacttaggctacactaagtttgttttttaaattgttctttctttgataataaattaaccacgctcagcttacttttttactttataaactttttaatttttaaaaactttttgataactttcataatagcactcagtttaaaatacaaacacattttacagctgtacaagaatattttctttctttatatctttattctataagcttgtttttgtagaaactaagtctcactatgttgcccaggctggtttcgcgcacccgggctcaagccatcctcctgcctcagcctcccaaaatgctgggattacaggtgtacaccaccacatccagtttataagctttttcttattaaaaaaagttttttttttttaagttttctgttaaaaactaagacacaaacacatacattagcctagccccacacagggtcatgatggtcagtatcactgtcttctacctccttatcttttccatctgtaaggtcttcagaggcaataccatgaatggagccatcatctgcgatgataacaatgccttcttcttgaacacctccagagggacctgcctgaggctgtttacagttaattggcttttttttttttttttttttttttttgagacggagtctcgctctgtcaccaggctggagtgcagtggcacaatctcagctcactgcaacctccgactccctggttcaagtgattcttctgcctcagccacccgaagagctgagattacaggcacgtgccactatgcccagctaatttttgtatttttagtagagatgggtttcaccatgttggccaggatggtctcgatctcctgacctcgtgatctgcccaccttggcctcccaaagtgctgggattacaggcatgagccactgcgcccggcctacagttaatttcttataggtagaaagagtccactctcaaataacaataaaaagtatagtatcgtaaatacacaaaccagtaacatagtcatttattttcactatcaactattatgtactgtgcgtaattgcatgtgctatacttttataggactggcactgcaggacgtttatatataccagcatcaccacaaacatatgagtaatgtattacactattacattggacagctacagcatcagtaggcagtagaaaattttcagctccattataatcttatgtgaccgctgtcacatatgcaatccgcggctgacccaaatgttgttatgtggtgcatgactttatatccactatacaagtagatgtaattaacctcagtcatacagataatagtaaaatagagtaaaatgagggatgatgatgagtttttgtttttgttcttgtttttttttttttttttttttgagacggagtttcgctcttgttggccaggctggaatgcaatggcgcaatcttggctcaccgcaacctccacctcccgggttcaagtgattctcctgcctcagcctcctgagtagtgtgattacaggcatgagccaccatgcccagctaattttgtatttttagtagagacgggatttctccatgttggtccgactggtctcgaactccccgatctcgggtgatccgcctcgcctcaggagtttttaatataatttattaaaccataagtttatataagttaatttttaacattggctatgttgaacgcttggctgtcaagcttaactgttagctctcacagacctggctccaacatgctactgtttctccttggctgtgttacagtacaaagttataccatgaattagcaagttcaggaccatcctggaaagccagcgtggaaaatgcagtcataaatggatttttatttctgtggactttggactggctgtctactcttggtctcacattctctactgcatatctctttggctaagaaaattagtattgaaaaatggtttatggatctagttattggagctagtattcaactttttagttacttaaaagataggacttaaacagagctgaattttatagggtcttttattttcttctttggtccttaagagaagactgcagaaaactagacaagaggaatttgaatgttctcataacaaagaactgataaaggtttgaagtgaaaaatatgctaattaccgtgaattgatcattacacaatatatacatgtattgaaacatcatactctagcccataaatataagaaattatcagatgtcaattaacaatggaataaaatgaaattaaattttaaaatgaaaacattctagaaaatattcccaagaagagatttatttatttatttttctggctatctatccttaagggttcgggaaaaaatggccggtggagaacaaaagattgaaattttagctcattcatgatgcacgtgaccgggaaggagtgttaagatgtcctgtacttccttccataatcacaggttgaggtgagggttgcctaaagtctgatcagccacattttgacagtggagactcagaggcctagttaggaacacagaaggaaaaatgttaaaggcagacctttataaccaaaacaatcaacaggtctaaaagccaaagaaaccagtatttcagaattgttaacttactcctagatgtgtgttaggcatcgggcttatcttaaagaagtgtcttagaccacagaaacatagacccatgatatttggaccaagcataggttaaaactaggggagggaggcacgaattacaaaaaaaaaaaaaaaaaggtgattccatgttagaatcccatgttgaaaaggtattacactttattgtaatacagacaagatttcactgtgttggccagactggtcttgaactcctgacctcgtgatcctcccaccttggcctcccaaagtgctgggattacaggtgtgagccactgcgtctggcctaaaaagcatattttaaaattagtcacatatggaagctaagtagtgcattttgtgtttccgaacaggacttaaaacgtcagtgccataaacactggtatgtattcagacacactggtcatatgtcatgaatttggtagacatatttgtaggcaaataatgtagagatagagtcacatattttaaactaaacaactcactatgaaccatcatgatggttcacacctacaattccaacactttggaaggccaaggtaggaagatcacttgaggtcaggaattcaagaccggcctgggcaaaaaagcaaaactcctctctacaaaaaaatttaaaaattagccgggtatggttgtacatctctgtagtcttagctactcaggaggctgatgtgggaggattgcttgagcccaggagtttgaggctgcagtgagctatggatgtaacccagaaagaccctgtctctaaaaaaaataaatatatacaataaaataaaaataaattaaaaatttaaaaagccactgtgattcttctctgtgatcattcgtaagtcatacactattttgtgtgggtgaaacatgtgatctgttagtgggtctgagaaaatcatatttattaagcaaaaaagtcaatatgtgcttgtgttttgcttatgaatttactcgaataaaatgtctgaaggtcttgaaacttcttaaaagaaaatggttcttacttcattttggtgtgtttacattaaggggagccatgtgacctcttatgagagttactgtcaaatttcaagtgcatgggcattgcctggaggacttgttcaaacacagattgctggaaagcccaagaatttgcatttgtaacaagtttacaggtgatcatgatgccgctttccctgggtgactcactttgagaaccactgtcttgtgagtttagagataaagaatggttgaggtcgtgtgcgatggctcatgcctctagtcctagcactttgggaggccaaagcgggtggatcacctgaggtcaggagttcgagaccagcctgcctaacatgatgaaaccctgtctctactaaaaatacaaaaattagccaggtgtggtggcgggcgcctgtaatcccagctactcaggaggctgaggcaggagaatcgcttgaacctagaaggcggaggttgcagggagccaagattacaccgcttcactccaacctgggctatagagcaaaactccatctcaaaaaaaaaaaagaatgggttggaaaaaatgtctgcacatcagtaagcacaaaataaccattgataaatagcattacaagcatccaggatcctaacaggaggggagaaaatcaggccactttagaaacacttttatgactggcagttatccagtttgctactaaggtcaggtctaaaagattgttaagactagcctgtttctgtatccatgggtatcagctggggaagccaagttctgtctttgtgcttggcagccctccccaatgccatgtctctgctgatgacattggaatttcctccaaattaaacagcctgacagcagccatctgtaaagaaggcagcaaggttacgagtgatcactggctagtgccatttctgctgccaaccaggcaggcaaagcttctggcatgttcttgaccacctctgagaagagttgatgtttcctttggggtatcatagagtttctgccacccagctctgtttctctgcctcctggtgcctgcccctaattattgcatagttgtcactgatcctggtaacctgactgctggatttttgctccagaaacctacagtaaaggagaccgtaggccaccagaagccaggaggaaacatcaggctgcagtcaagggcactgccttctcccctccaggctgctgggctttgagggcagagaaataaaaagactgaaagggattagaggcctggagtccacaacaaagccctgtagtcatccaccaccttgcacagcctcttcctgccatgcttacaggtgaaaagtctagttcataggacacattgcttttccagaaccttccgctgccttccagagccagcattcttcctgaaaactctctcttgccagttgtttgccttcagagttacagtttaaaaaccaacacttaaactgatatcctctgaagaaaaaaacagataacaaattcatgaatcatagttatacttaaatttcctccgtcacagagaaacatgttatttttagaaagtggatcccaaacctaactgatcagaatcccttgggggaaatgtttttaaaaaataccattacctgtgcactggcccagaaaatccagggccattagagactgcaaatgtctgagaatctgtgtttcctaaaaggcacaatggtgattctgatgggcagccatgtttgagaacctctgattgaattgtgcacaattttgatggtgctgctgttgcattataggtaattcaaagaagagcttcttttttttaaaaaaaaatagtaatctataaatataatagttttcatctgaatagtgttttcttgttttcagaagaccttcataactttttttttttttttttttttttgagatggagtcttgctgtgtcacccaggctggagtgcagtgacgcaatctcggctcactgcaacctccgcctcccaggttcatgtgattctcctgcctcagcctcctgattagctgggattacagacgtgtgctcctacgcccagctaattttttatatttttagtagagatggggtttatccatgttgtccaggctgatctcaaactcccaacctcagatggttcacctgcctcggcctcccaaagtggtgggattacaggcgtgagccaccacgcctggccataactattatctttgacaattttcctgggaggtggatgacaggacctgttactgacgccagtttacatctgagatgctgcagtggagaggaattggaactagaaccgacacttacggcttcttgtctggtgtactctctgctgttccatcttcattgcttgtgtgcatgcgtgtgtgtgtgtgtgtgtgtgtgtgtgatgtgtttatttgactccttgaatctatgttgtcttgtttttcgtaaatggattaacgccactaccacggatcatcagggagatatgacgctagagatagataagccaaatggaggtagaaaatccaaactgaaaacagggagagaagctaagatagacccaaggagtctaacaacccaagttctaaactagagagaaggccactgttcatctatttcagggatgggcagttatggaaatagtatgaactcaggcatcccaaaggcagtgcagtgtatgagagaaagatgcttgcatgcatactcccagcaaagctctcagtggggcccaagatgcagggcatggagggtaataaagattagccaggaaggtgataggacaacagatactgaaaacatggcaatgaaaaaacatcagcattcagaggtgagaattaccattgccagaagttcttgggaagtaaaacaagtacagagctatgggtcaaggatctcacagttagagtactagtagcagtagggtggacttgagtctgtagtttgggaccagctgctaacttaaagcctgggaagctcgtgttagccagacattacagatactttttatgtcaccttgaacaagcttcactatccttatatttaaaataaggagtaggcctattaataatctgtatgtatttcttgcagtaaggaaatctaattttgggaaatgaatagcaagaacatagcttggtgcagtgagtcagtgagaggatttacaaaaggtgaacgtacacaggactcttaatactgatcctgggctagtcatgtcattgcacatgacacctgctgttggaaggaacaggttaagcatttagttgtgtgcaatgaacctgtgagccctgtgggctggtcccacttatttgaaatagaacgattgcagtgcctatgtgagtcagggtacacctgaatgtttagttagtgctttccattaacccttttcaattttgcttctatgttttcttttcctccagaaggaaaatgagcagaaggtgtgtcacatgctcgctttttatctgctgcgtagttcttgtagtgaaaggattgtcgataagttcagaaaccaagactactgctgcctccccttcattcattcagtagtcttacagcctaaagaagacaagaaaattaaggactctcaaggcaaaaggaagtcaaatgaaattgggaagtgggtctacagtaaatgcaatatctgtcgctttcttttagaactgcataaaccacatggaaattttccgtgtatatttgctaccaagggatgctatcatctttttctttccttttttttttttctttttttttggagatggagtctcgctctgtcactcaggctggagtgcagtggcgccatctccactcactacaacctccgcctcccgggttcaagcgattctcctgcctcagcctcccgagtagctgagatgacaggcgcgtgccaccacgcccggctaatttttgtacttttagtacagacgaggtttcaccatgttggtcaggctggtctctcgaactcctcacctcgtgatctgcccgccttggcctcccaaagtgctgggattacaggcgtgagccaccacgccgggccactatcatctttttaatttaggcacatagtgctcaggaaaagacaaggatgatggatggtaattaagtaaatgaagacagcattggtcaggagggcagtataaacaaagtaaaatagaaagtctcttgttctattttttttaaataatgataattatatatttcttacagtcatatccagagcttacttgaatctaaagcagtatttatctttgcagcaagcctatgaattagctttacagactgtaggatgcagagacccttggattagaaaagttcagtaacccatgagcagaggcatgagaatgttaaaacaagtcactaaaggtcacatagcattccactagctgggctgtggttagcactcatgacctcctggggtctcatcttttctgaatcttattgaatcatgccagctttctgatatggtccataaaatgctgatagaaatcacatgtgaagttcccaactgtgaggacagcagacttcctttagaagataaatactagacctaatctaatacactttatttgacgtagcagaatttctcctgcatccttatttcaaaagcatacctgcctgtggtcttcccgggtcttaggagagtccatatgtctgatggaagcagacaatctagtgctactcagagaaaccaccacttgatcctcagtttttttgaggaatttcatgtgtttttatgtgaagaatcactctcaggaaagttctgtattttggtagcagagatcctgtcaagaaggcagtgagatagatacacataataagctgttcatcattactgctgatggaactcttcccaggcctgcagctgacagcattgcatgggacctgcagcccctttcaccgtgactgcagattctttggttaagagactgtcagtggtcaaggctctgccccggcttctcgggatcttcacactcccctgtgcatagtaggctttgggttattggccatcatgaaaaccaagattgtcgtttaatgatcacatctatggacttggggtcggaggaacctggattcacatcttggctcctccactgactggtaagttgcttagattagttgcttttttcctctctggctgaatttatgcaattgggagttttaaaaagtatccactaaattcattgttgttgttgttaagatttagttgtgtattgtacactacctggcatgtagtggatgtttggtcaatggtaactattaaaattattgcagatatcctcaggtattatatttttgacaggagatatctgatagcctgattcgatattttatgtggaaggaagaattaaatacagaagaaccctaagacaatgctatctgttctagagagtgtttcgttaaagttgcagtgtttcataacgaagcaggcaggacggccctctgctatgcagagctctcccgctcatgacaacacaacaagcactcccggttcatccctacctactcatcccaacaatgtttccaagttgttttaaggattcagaatggccccactccttttcagatgtccctgggagggtaacccctgccttgtttgagaatcacgagcaagcatagtctgagtttgacttctgtacccaagtagcagggcaccacctccctctcagtggctgatggagaggtcttccacagtgaactttcagtgaagaagttcatgtctctctacattatctgttttactcagcattcagagatatgtggtgcctccacaggggccatatccaggctttctgatgaccctatagggagcaatggcaatttaatgaggaggggaaaagatcagcttaacctagcttctacttcatccgggttctcatggttagttgagagtgctgatccgtgaccaccattgagtcattgatctcccgctcttcctagtcaatctgtcattcagagatttgcttgatcccttgtgccagatgcatgtatttaacaagctaacatgcactaagcatctgctatgtgtcaggtactattagacgcatcatactacaatgactaagacacagtccttgtcctcaaagaaatagtagccctgggagtaaaaatgatataggggaggctgggcacggtagttcacgcctgtaatcctagcactttgggaggctgaggcaggcagattgcttgagcccaggagtttgagaccagcctgggcaacatagtgaaaccccgtctcctttaaaaataatcaaaatatttttaaaaagtgatttgaaggagtaacatcctgttcatgttcagaggcattcagcctatgagcccaaggagttacgctcatttctctctatgtacatcttttagtcctaatatgcgtttcttcatttcttttatttttgttaccattatactctttacacaaggtccttcaccagagacctgttatcagtgtcagagacccagccctggtggccttgtgcagcagatcagaataactcaaggagctcccacatttgctctcctgactttctagaggcacacgatatccacatatgttaatgtattggttttatcataggtttctccttgcatttctttcatgtaaaagtgttaagagttcagtctgatctgaaagcaaaagtttaagttctcagcataactattcttacaatcttgtgcctttgcaaatatgttaaaatgttctcagccccctccagtcctgaactccccatttttttatggttaacgcgctgtcaccactacccagcagactacaaagcagcagcaagtgcaatgcagagaacgcgatgtagatcttgttcaaagcagctgacatgttgtcatctcaggaagggcagaatggcaaggaggagtgattgatggaaacttgatggagcaaccttcacttaattatttttgcatagattcctgaattgtggcttctttgctggaaaaaataataatgatcctgtaatgcagactgctttagaggctggaatgtgtcatcgtatgtgaggattaccacttgctcttttagaaccccaagcatctatctctacctagaaattttttatcgtgaagactaatagccttaagggtgaaggagaggacagagaccctaacccagagtaagataggaatgattaggaatgattgttggtgataatcagatgaacacactgtagccctgtatcaggagagaaaatgtgtttgagattagcacgttatcagaaaaatgtttgcacttatcttattctttgaataagttgcaagctatttctcttctttcacaaaggcaaagtagtaagccaaacctgtaatcagaaaaatattgatatgttagatagagaaagttatttttgtgtgtttgtttcagttgttgaatcaactggtatgtatcgagtacctactgcatgtagggggattgtagagaactttcagcgtcaagttagagattttaaactttatcctagaagtaaaacgagaaattaaggcactgagttagaaaggagctagaccatgatttctcccatatctcttgtgcaaatggcactagccaagccagaagcccctatgctgttcctccatgtgcccctgcccagccattcagcagccttggtgctgagtctgcctgggacatctcccctgtccgcctcctcttctccatgcttactgcccctgcagcaggccaaacctgatgacagctcagtggcattgcagcaagttcctcccgactgtttgccttgcctgtagaacctggtcccttctcatccatcttctactctatgaccagagtgacatttttaatcaaaaaatgttcctgcctaacccttctgagattctccataccttcaagagatatcttggggagagaagggcactcgttacctccttcctcccctcctggcatgccatacttgtgcttccctgaatgtggcatgtccccttatgtgactctgcatgagctccctcctctgtctagacaatgttccctctcacatcacatgcagtcacacattcctgtgtactcttcaaaactcaaccctgccatcagctccaaggagcccaccctaacttttccctcctggtctcactgagccactctgtgcttcccacccatgaaactcatatgtaagatttttagtgtctgttctcttgaccatctctgcacactggatacagatgtattagtctcttctcacattgctatgagaactacctgagactggataatgtgtaaagaaaagaggtttaattggctcatgtttccacaggctgtacaggaaacatggctggggaggcctcaggaaacttacaatcatggcagaaggagaaggggaagccagcacgtcctacgtggctggagcaggaggaagggaaaggggaggtgctacacacttttaaacaaccagatctcatgagaactcactatcatgagaacagagagggagaaatctaagcccgtgatccagtcatctcccaccaggcccttcctccaaacactggggattacaatttgacatgagatttgggtggggacacaaatgccaaccatatcaatggagctccttgagaacaggaactgtgtcttttagatcttctgttttatatgtctgatgcatagtaggcagttggtgatcactcatttggtgaatgaagtgttaggctgaactgaagtgggaatgaatatgaagagataccacacacctgcattccttgctatctgtgccatttgttccatctcatatctcatggtcacaccagtctgagcaaggtcagatactctttttagagaaccttctgtggccttattccatgttcagttgtttaatcacgattacctttatttttgtattggtccatgtcctgagtattttttaaagcattgactgttgtggatccatggagaagtcagagaaaacagatgaagctctctgataggaaaaaggattgaataatcttgccatccaaactgtggtatcaaaatatgactatatatgttgcaatcaggtgcatgcgtttcttggctttcctggatgtgcaaaatagaattcaagacagggtacagagagaacacattctacataccccacataaccttggcatgactgtttggaccttgctggtaagaagtggcattggctagtcttttgttcacaggctggcaaggttgctcctgattttctctttacacggataattcctttactgaccaaatctcatgagagcaaagtgaagtatcctgtagctggcactacattcatgaccttttctatgacaggttaatcatttctttgtgtgttcactcactgacctttacttcattggccaaaggagtgccccatgtcaaagtaatgtcctcgttcctccattccatcatccctttggggcagaaaagatgctgtcttacccgtttttgtccccagactagctgggtgcctggtgtgtagatgttaaatgaataaattgtttaggcaaagccgttagtagcatgatctaatgaccacaaacagaaaagtgtgtgtggtggggaagggcaacttatattttaagaattgtgttttaataagtggtgaattatttcagtataaatccagtattatcattaataatagataaatatattgagcatttaccataagcaccatattctatcgcctctcccattacgtgaaagactaagttttatagtttgaaaagaaggaaaataggaaatatataactacatttaatattatagcataaagggctcaagtggaatgatgctggtatgacagagtattcccaacagtcctcccagttctttttacattaatataaaatgttccatgaattaaagaaaaatatagcaagtcataaacatttacaattctctttcctcaccatctaaggaggacaagttctgtgcttatttagcttgctattccttgtgaggtcagaaaggtcaatgattaaacttagattaggccaaattcctccttaagagaagatatggtgcggggtagggagtggggaacataagaacagccattatagggacctgtaagagaggagggcgagatgggaggaagagcaatcgtcctgggaaaagggaacttgggacagagaggagtaacaaggctttcagggagtctttctgagcatggtgccatgctccctactccccacttccaccctccccactccccccctcccattcacctctgccatccaggccttcccaggaacacttggccaagacttgcaagtttatttattttttttttagctcatcagctgtcattagtgatagtgtcttttatgtgcagcccaagacaatttttctccttccagtgtggcccagggaagccaaaagattggacacccctgctctagatgtgagtcttggatgaccacccttcactctacctaggctacagtaacagacgttgaaagtcagcatcttcattgttatggaggaatggaaatgggataaactattttaaaacaattttggatttaaaaaaatagtttaaatattcctgttctctcaccccacccacccctaacttctttgcattattaattttcttagctaatcttatttctaaaaaagcaaaaccttccaagggaattctttttcttttctttagggagagagtctcactcttgtcacccaggctggagagcactggcacgatcatagctcactgcatcctcaaacttctgggcccaagtgatgcttccacctcagcctcccaagttgctgggactataagtgcacaccaccgtacctgggtatttttttttttttttgagatggaatctcgctctgttgcccaggctggagtgcagtagtgtgatcccagctcactgcaagctccgcctcccaggttcacaccattctcctgcctggctatttttttaagcttcttgtatagatggggtcttgctatgttgcccaggctggtcttaaactcctggcctcaagggatcctcctgccttggcctcccaaagtgctgagattagagccataagccaccaggcctggcccaaatgaattattaatttgttttgggtagaattactaatagccaattactagttagtggaacttcaatttgggatgtttttatctatttgaataaactttcattctgtataactccatgtctaaatctataaatgtagacatacatcagtatagaaacgtcagtggctcttagattgggtactttaataataactctccatgactgaccactggggacttctcaaggagcaggagaagtatctaccaaacgtagatacctgagaaatagtggagtctgctgtaatgttcactgtggataacctgactggcagagttgtcccttctggaagagaggcagctcaggtcactgtgtaaggcacctgtcttaacttgcaatgggaattttgcagtcaggtgaggggcacaatatatgtgaagaggaagtgaatgttgttgatagcatcacatcataattaaattccagccactggatgatgaagtcattccttcacacacaaacggcattatatgcctgtaatatttttccagggctgccattacaaagtgccagaaactgggtgacttaacagacattgagtgtctcacagctggggggcctggaagtcagagatcaaggtgtgggcagggccatgctccctgtgaagatgctcgggaaggatctgttccaggtcactccctagcttctggtggctccttagcatgtggctctgtcactccagtcctcacagagcactctgcctgtgtgcctgagtccacatttccccctttttttttcatgatggagtcttgctctgtcacccaggctggggtgcagtggtgcgatctcacttactgcaacctctgcctcccaggttcaagagattctcctccctcattctcccgagtagctggaattataggcgcccgccaccacgccaggctaatttttgtaatagtagagacagggtttcaccatgttggctagactggtctcgaactcctgacctcatgatccgcctgcctcgacctcccaaagtgctgggattacaggcgtgagccaccgcgcccagcccacatttccccttttcacaaggacaccagttctgtcagattaggaacccctctcctccaggatgacctcatcttaactaattatatctgcaacaaccctatttccaagtaagttcacattcagaggtattaggggtcaggatgtcaatatataaatttggagggacagaattcagcccataacaatgcctgccagtggtagttttttgggggtcagggtgagtctagtatctgcattttcaacagcatgcctttttggggagatgagtgtcaagcattcactgatttgaggtaacggggccctcttgagtctgtgatgtaatctcacactcccctaagagctatttatggcctacaagcctgtgcacatttgaatgcgcgtgtgcagaaaagacaatgagccagacaggcttctacacccacttaagagcactcacatggatcagtcacccaccctgaatgccacgttagttttgacatctgaaatgtgtctggcattttcaggcagagaaggcttttaaaaaaaaaaaaaagtcacatggatgccagttccttactatctccctaaaagagcctaaacacagaaatccagacacaggaactcacaagaatattagataataaatagccaagcttctgaagaggcctggaaccagagaatgatatttaagggttattaagcttaattttttgcactgtggtctgcctggcatatagtagacactcactgaaagtttgtgaacagatgactaggagagtctctgttccgtgggtatgaatcttaaagatgcatgtattcagccccttctcctggcttctgttctaagcagagggaatctgatgccttgtttctgcgcatctgtgatctgggcagattacagatgtcacaagccagtgatgtacacctggattgcatcctgaccaaaatcagggaagtacccgctggcatgttgaggacctcctttgaagaaaatcctgtggctaaaccaattcattgcccttgggagagaaacattctatagcctgctgggtggatgtgtacagtccatgtggacccacctaagtttcctattttgttccttctttcttgttttcctttccttcctcttttcttactttttaagccacttattgagtttatcctttcaaaactcatcttgaggatatgttcaaaaatgacccatctagagcttcctgtacacttctttgcagagtgagttgctgctgacttatttctccttccagcgtcttgctgatgcctctgtagagtcatttattacctgcgtaagagtgacctctacacgtgcctggttcccaacaagacatggagtctcaactgaattttactcatctctgtttccctaatacctagtgcagtacctggttagcacttcctggatgttcagtgtatggttattgaatgaatgaatgaataagctgttactttctgcttgcatagcactgttctagagtgtcatggaggacacaaaggaatagaattgatagtaggtcattcttcagttgcgttgcatcacaagggtaaaacgtgtacttattcaaaataagtggcataataataacttcttaaaatttttattttatttttccgtaagttattgggatacaggtggtatttggttacataagttctttagtggcgatttgtgagattttggtgcacccatcacctgagcagtatacactgcaccatatttgcagtcttttatccctctccccactcccactcttccccctaagtgcccaaagtccgctgtatcattcttatgcctttgcatcctcatagcttagctctcacatatcagtgagaacatatgatgtttggttttccattcttgagttacttcacttagaataatagtctccaatctcatccaggtcactgcaaatgctgttaattcattcctttttatggctgagtagtattccatcatatatatgtaccacagttcctttatccactcaattgatgggcatttgggttggttccatgattttgcaattgtgaattgtgctgctataaacatgcgtgtgcaagtatctttttcgaataatgacttattttcctctgggtagatacccagtagtgggcttgctgaatcggcatcataataacttaataagtcaagaggaggtctgggcactgtgctcatgcctatactcccagcattttgggaagctgaggtgggaggactgcttgaacccaggagtttgagaccagcctgggaaatatagtgagactttgtctttacaaaaaagttaaaaaattagccaggggtggtggtgtgcacctgtagtcccagctactcaggaggctgaggtgggaggatatttcagccagggcagtcaaggctgcggtgagccgtgattgcaccactgcactccagcctcggtgacagagtgagaccctgtctctaaataaataaataaataaataaataaataaataaataaagtcaagagaggggcccagtggtgtaatggaagagcactgttcatagaatctgtagatttgttttctagtcctggctccacaagttacatattctgtgctcctgggaacttcccttaacctacatgagcctgagtttactgatctaaaaagtgggcctaacgcctatctgaaagaattactggggatattaagggtataatgtatattataaagtgcttggtaagtcatagcatggtatctaaatctaaggtatgttgcttttatgacacaaggcagtatctgagttaggacagaccaggggagtggtacaatcagttaatgttctgagttgctgggtaggagttagcaagtaaggcacgtgcaagaattagaacttggccagagctttgaagaataaggccacctggcatagacaaagggaagcagtgtggcctgagtacctgcacacaggttgtggtgggccaggaggatatgaacgagccccatggctgccatagagggctggtggtgcccgagatggccctccttgccatgaagtaggcagaaggcgcttagagctctagtttcccaaatggagctcaattgcttgtcatattacatacacgtgctgttatgtgtgatgatgctctgttctaaccctgaaagacctggtggagccttagcaaatcactggccattctcccaaacactgcgtgtgcttatgctatgccgccatagttttacaagcatttttcagcgtttatgcaaatgctgcccttctgtctttggtaactgctttgctcatctttcaggattcagcttacatcttgtcttctctgtgccacattcctgtcagcagccacctcacaccacccgctcctgtgcacacaggcgtacagagatagtcttgttcctctctgctcttagagcaccattcagctacccccagtggagcactaatcccagtgagctgtgatggtttcttggtgtctgtctccccgcgagaccatgggctcttggtgaacagcggctgtagcctgttcagctctgaccctccggaccctcatataacctgtatgacccatgaaggtgcacagcaatgggaaggatgagggaagaagaaggatcttttcaaactctgtacattcttcacacagaaaagcaggctcatatcagctgacttgttctcccaggcagagaacaagagtgtgccacattcactccagttgaatggtttcaaacttttcttcctttgaggtggatgtatttttggcttttggcagtgtcttagtccatttggactgctaagcaaaataccgtaaacttataaacaacagaaatacatttctcacagtgctggtggctgggaagtccaagatcaaggtgccagcagcttcaggatttggtgaggtttgatttttttggttcatagatgacaccttcttggtgtgtcctcacatggtggaaggagcaaggtcgctctctggggtcccttatagatgggcactaatcccatatatgagggatactgaaagtaaattgatggaagtgctcgtgtgaatgaatgaatgaatgaaaccattttgaagctagattgctaggttcctgcaggttatatctttgtatactccttacctttcaagaatgtctgcagctctctgcatacaataacttccttgagtatatataactacagtatgacaaggcttttaaattgaacaattctaaagactgtttttttgagtccaaaaagtagaatttggtatcaacattaggtttaaaagaagtgatttcagagtttgtcaactattcaagtgtcagaaaaaaataatgtaaatgatgtgcttaagacatttatttttgtattctcgattctcctgaaataaagggaaattgtcttgaaaagctgtagattttaaatgaaaaggaaagcgggaaggtgacataatttgcctctgcctttgcagaaattcaagtgtatatggcctctctccaatccaccattttcccacctccacaggccccatgtcagctgtttccttcatatcattgcaatgctttgagggtgattgttggtttaagctacagtcccttcaaatttgtgaaagactaaacagattgataacaactccacctagattaaatgaaattctgtgggtagacaggctagtcaaaatacaatccccacacaccccaagtgagcattgcttctcctttcagatatgctgtgggtacaaagaaaggatttagtccaaagtgccttggggttttgttcagtccagagtgtaatttttttctctcttttgcctatagccatttctgtaacattactgaaagggcttttttcctaatgaagcatgaaaattgatcgtatcttgccaggagagttcttcctaagtcttaagatattaaagatttcatgagaaccgcatgaagaatatcttcttgaatcatttacatttttcccttttgtaggcttatgtaaccatgcagaaaatctaataataagtgtgctattagtgtaccatgtgccatcccgcaggcagctgtgccatggggcaccagtgcccagggcttgtggatagcattaacctgtacaactttctaaagtaaagcccagtgggaaatctgtaggtaattgaacagatagtccatttttatcagacttccccctgccccttccctgttctgtcttttctcttttcttgtgccagaaggaaacaccttggccataggcctttcattcacaatggagtatattttccaaagcaaatagcttggactatttcaattcccagagcaatctaggtgggcacacagagctaaatttgggtttgaaagaactcttaaattagtatcataggaaggcaatgagcaggaaaaaaaaaaataaagatacaagcattgtggtctgatggaaattatccagcactcacttacaaatgacaagtgggtaccacccagcctttctcatgttccaaaatttaataaagggttccatctaggtcccccagaaactactgtgattatcagggtgagagaagggggaatgatgaatttttgtaatgccccaatctttgtaaccaggcatagaaggacattcgctgggctcaggatgggtgttagcatgtagtggataaaggaattgcagagttgttgacagctgtttcctcagagacacttgtcctgatgatatttgctttggattctaagtaacagagctgtagttcttaaagtttaaattgaaaaaaaggagttttctgtcaagtggcttagtcatggaaatcagtgaagttaagcttgggcaataatatatccttttcaaatccaggtgccttcctgatcatgccagagcttttgtgactcctttctccttggtgttcttcttttgatgcggcgatagggtctgaacacgtccaggctgtctttgctgggagagggcagaatgcctcggctttcttcagccttgcctttcttcattgtcttcaccctgcagcacttctgcaaagctgctggggtaggtgggtgagtgggcgtcttttctttgctagcccaagctgagttctgaagggaagttagcagggctcagctgctgccgcaaagtcagtcagaccaattctcatttgcatgcctacagaattagacatattcaggggctcgggttaatgccataccctcctcttgtccttggaaaactgtaagaatgcgtgcaggtaactctgcagcaattctgtgttgctcagatgtatttctcttctttcagaattcctccttctatagcattcccctaatatttatgtgctggggctttcttctttcatcccaggccccagcttcgctctatatcagacagaggtgggagctgctgatcaagggggcacacttgccatccaaacctcacgatgctcacaggtgtcctttcaaccctgctaacccagatgatacatcaccatttatacctttggaggcattttctctttaattgatgctcacttagacctaagattgttcattaaagtccagaggtgctcattaaaatgaacattggatagtgtggtagatgcaggttatcattatgaatccaagaaagggctctgtggaacttgttatatacggcatttataggttgttaaattaaaggattagtgttgtgctaaaccattttcaggttaatcagttgtgggaaaccagatctaatgttaaagcaggcttaaactatggtttttatagtagggaagtttttaagctactgttatttctaataaaccctctagcttgctaatcgagcatacttttcaatttttgcacttaactgaatatggtcttgttccctaatttttttatgtgtgggctttatttcttcaagctggattgtaagttcctttttagcagggtctatgtcttttttttttttttttttgctcatatcctaaaagcttctggtataattcgaggtatatagcagatgctaaggattttattgagtgattactacatttttagagtgtcattacaatgtattatcacctggtttatgccgtggtgctttatgtaacatgtgcctatttacagaacattgatataacatgttggtctgcaaccaggttgttatcagcaataggaaaagcattacagagttcatatggaagtagaggagaaacaggtctaatttgggtgtgatgccctgtattagtctgttttcatgctgctaataaagacatacccaagcctaggtaatttataaagaaaaagaggtttaatggactcacagttccacgtggctggggaggcttcacaatcatggtggaaggcaaaaggcatgtcttacatggcagcaggcaagagaaaatgagaggcaatcaaaaggggaaacctcttataaaacaatcagatctcgtgagacttattcactaccacgagaacagtatgggggaaactgcccccattattcagttgtctcccagcaggtccctcctacaatatgtgggaattgtgggagctacgattcaggatgacacttgggtggggacacagccaaactatatcatgccctaacctgatcagatatggcttccagactggcccctggagtggcctgaataccttcaccaagacacgtgtgtgggacagatcaaaagtttccatctgccatttgtctttcacttggtaactgctaatgattgcttgttaaccatacacattaatatgcccgtgaagcagatagaaaataaaataagtaaaaaattgtataagtggaaaaactaagacccaaacaagaaattatggatcatttctaaatggtggccaggacgtttatacggagaaaccataccattgaaccataatcaatgtaagaatacaactgatggtttcagactttcaggaatagaatgagtctcaggcagacatgttctcaggcaacatggcctgggacatccccagaaacctcctccatggagttaacaggacacctacatggccctatgtgtccctccacttgggcctcttgttcaacctcgtatcacatgtccccttcctaccacataaacttctgtctctacattctctactctaccacaggttcatttatttgtttgtttgtttgtttgtttgtttgtttgtttatttatttatttatttattttgatacagtgtctcactttgctgtccagctggagtgcagtgtgcaatcacagctccctatagcctctgtctcccaggctcaagtgatcctcctgcctcagcctccctagtagcaaggactatagacatgtgccaccacgcccagctaatttttaccttttttttgtagagatgagttctcactgggttgcccaggctggtctcaaactcctgggctcaagtgatccttctgcctcagactcccaaagagcttggattacagacatgagccactgtgcccagcccacagtcatgttttaaagtgtctgagctataaatactactataaaggtgtcaactggttgtatatgtgggcccttggcatttcagaaatgacagttattgccaaccattaccaaatggaatccattttatccaaatgggcatggttggggctgagcatgggatggagtaatgcagtcttattgcatttcagtgttagagggctttcactcggtttgcagtttctccacagctcacccaccaattctacctgtgtacttcttttctgttccctctcaacttcttttccattctctccttcctcttgtttctgtccatatctctggcttcttttaatttcccttttcccttctttcttattggtctggccctgggtctggtgagaccaagggcacagaaggatactggctccatgccaacctttcctccaaggcacaatctccttcttggcatttactgagatgttcaacttcctgtgtttctaatattccttcctgttttataaaagaaaaatagattggatttgcaaagtgccttaatttgttgattttctaaaaagcaattttaaaaatgtgtatcaacaatatcacatacatgtaactgatttattgactctggcttgccctgggtttaatcacacataaagaaattttacaataacacatgatccagtagagaaagaagtcaaagaaatatgtaaagtcctgtgacctctgtagacatttgggattaaaccaaattaaaacacctgtatgggctgggcatggtggctcatgcctgtaattccagcactttgggaggctaaggcaggaggatcacttgagcccaggattttgagaccagcctaggtaccatagcaagacccaatctctactgaaaaaaataaaaataaaaataaaaataaaaataaaaataaataaccaggcatagtggcatgcctgtagtcccagctactcaggaagctgagatgggaggatcacttgagccagcagtttgagactgcagtgagctatgattgcaccactgcactctagatgcaacagagcaagaccctgtctcggctcaaaaaaaagaaaacacttgtatcaattcaggtcaaatattggtttcttttttttaagagcagattaacatcttgcatatcttttgctatcacatttcttcttatctgaccagctgaaatggaactagtgttaaatacaaataataaaacctgtaaagatcctaagtttttgcatggtacaataaatcctcactcattcacatgcttggagaaagtccagtctgattcaattaatgaaaagcaaaaaaaaaaaaaaattgtaactacataatttttatctcatgtattagctcctatttagttcacataagtgttcaaataggtactcatttttaattaacaaaatatttgtgtgtagtgagtatttttaaaccaattaaaacagttccttcttgtaagtaaattaagtgctattcttagacgatggtatgcatcattcatttgctttgcaaaccattctttcacaccattctagttggtgtgaaagcaaattgagcccatctctactggaatttattgcattctcttaatttctgacactctatgctcccaatagtagggactccatcttagccaccacgacatcccaggcatggctcctagaataatttcagctctttaagactcaattaatatttgctcactgattaatatttagctccattaatttatgtgtccaaattccttaccatttgccaagtgcttttggattttacagttagttacaaactgtagtttaaggtttttctggctttacttcattcttcctttaactagctttaaaaaactagtttataattctagttacaatacaatgttaagtgaaagaactgattcaaaattatatattcagaattattctaactttgtaaacatgcatagatatatgtgagctttaaaaaagaaaattatatatatatgccaaaatacaatcaaaatgtaaatagtggatatatcatgttggagatattaggagcagttttatattttttaagttttctgtgtttccacatatgatcacactttatttttatatcagaaaaaagctatcttagttgtgcattgtacattagaaatattagttttgaagataacctaaacacaagtttttatttcttctgtcacagttgcctcttttcttaaaatcgtgtttgccagtttctttcacgacactgcaaacaattttagtagcttcagttctttgataaatctgtagcttttagatctttgattactattagcaaagaaaagatagacccaaatgaaaaacagttgcatttttgaaatatgtccggcgggggttgatgtggaaagaacaattcctctcaactccagggtcaaagcagcagccctgccaggctctgtcggggtcgcctggagaacatcacttaactttctacatcagttcctgcttctggacattataacattcatgatatccacctcatgcaggattcctgggaggagcagatcagatcataatgtgtgtgaaggggctttgaacgacagtcaccacattattaccaccataagcattatttccatttcaaaaatggtagaggagggaagatgcagatgttctctttatgttggctcggcaccaggcacgtccaggttgtgctgctttaccctccagcatgaagagttagaaggtaaatatcgatattgcttttcataactaatagcttcatagttcatgtcaggtgatttcttggcttccgttagcatttcagagaccattatacacagcagccatcctctgcagagctggagaaaactcatttttcaaggcaaatagtcccaagtcagggttcagtcctggtggaatgaaataaagaaggagagtttatctttaaggtaagctagcatttaagtagatgttggatattatcagagatgcttatgaggggcagagagcattgaagacttataccctttgcacatctttaaatgcctgtaagtgcttaccaggagccaagagcgaacgggtggctgcgtgcaaatgctagaggttaacccctgtccatgggcatttaccgcatgagtaaaaatttattgcagagttcaggactgtgattctgctgctcatttctgtagcgtatttctttatctgaaaggatgcccattgtcctttctagctttttgggccataaccgtgagggaaggcccaaaggaagaacctctgttggagatcaggtttattcatccatgtgggtggaggtacgaaggagggaagaacctctgttggatatcgggtttctttgtctgtgtgggttggagactagtagaataggggaaaccacatactgcccattcctccaggatcattttccatttggatatttagaaagcaacaagagaggagttttagaagacaaggtagatgatttcaagttactttaacatagaggaagaaagtttccttctatttttaatggctagtgcatgatttgtgggagtgaagattgggagggggcacggacgaacaccaggaagaggcggttaatttattggtccccattaattgaatttaataagtgagttttgtcagtttagcaatatccattagtttcagagagtgtttcagtattattctgtaaaagcatccagggatatattttacagctacagcatagattatcttgcacacatattgaagtaaagatacctttcaacattccagatactgacttttcacccaaatttgaaaatctccatttagcactttctaaaataccagtgaaaattaatatagttttgtagatttatgtactaagatgcagattaagacatgtggaatctaatgaacatagcaggaaaagaaaattttctcaagtctgttcattactattcctcatcacattttttattatttaatagcttattccttgaatatgtgtgacttgggattagatgtgccagttggaagacctcagaggttcagaaattcacagacatgtgaaatataaaaccgtattcatttagcagatactgataggcatataaaatagaaccttcatcatctatctttagaaaaagaagattaaacagaagtgtaattaatttgccaactctgcttcccgattgagacatttatcaaagttgatctttaatcattagtttcctaatctgtaaaatgaagtctattatgacctctaaggtctatttgtaacagttaggattaggttcagttccatatcaccaaaaaaaaaaaaaaaaaaaaaaaagaagaagaagtcaagccaaagaaatagacatttatttttctctcacataaaagtggttttgagaggtaagcagtccagggtgattatggtcactgcacaggctcagaaacattgtcacctttctattctgccatgctgtagtatatttcttttcttttctttctttttttttttgagacagattcttgctctgtctcccaggctggagtgcagtggcatgatttcagctcactgcaacctcttcctcttgggttcgagcaattgtcctgcctcaggctcccgagtaactgggactacaggtgcgcaccaacatgtctggctaatttttatgtattttttagtagagacagggtttcacatgttggccaagctggtctcgaactcctgacctcaagtgatgcacccgcctcagcctatgtctcacatacaagatggctgcatagctctagcctttaacattaccattccagaaagcagaaaggaggaagagacgaaggacctaccccctttccaaagacacttgccagaggaaccataccacatttttgtttacttcatgtcaacaagaatttagtctaggcatacctagctgcaaggctaggcataccttcttgcaagtctaggcataccttcttgcaaggcaagaagaagatcaggtcattcagttgggcagcaatgtgtctacctcaaaaccaaggtttctacttctaaggaaaagaaggaaagtgggatattggggtaagcaacaattatccacaggttttgagctcaaaaagccgtgatcgcatgtttctgggaaaatttgacctatacaatcgagtctgaatgtgtgctgggtgtgtacaaatcagacaacttcaactgtgagccttcattagctctcccctttatctagacttaggattgtatttccaggcataggtcagaatctttacactgattgtgtgtgtgtctgtatgtgtgtgtgtgtgtgtgtgtgtgagagagagagagagagagagagagagagaaacagaatcttggctgcaagatgtgctgaatataaacacaataacttagcaatttataactgcccctttcccatctctgccccctccccagtatcagcatacgcagtgttacccccacactatcaatatgtcaatgattaatagcaactggcaaatgtgtgctttccatgagacttgtatgcaaggttactcgggttcacagaggctgctaataacagcagcactattgaattatgctatgtgtctgtgtctgttaagacaggtcggaggacaggggaggaaacttcccccagggtaattgagagacaaagtcactaaaagctacagatctccagtttgggctctatgcatgagattgttcttaaaagtcaaagaaatataaaaggaaattgcacatttgtaatttttttaagttccccatttcatagctcattaaaaccaggactttaatattctgggtcagaacccccattggatatttttgtgaacatgtaacatgtgggttgattagaggtttgggcctgtttttttctttttctttttttttttttttcagacagagtctcactctgtcacccaggctggagtgtagtggtgtagtctcggctcactgcaacctccacctcccgggttcaagtgattctcctgtctcagcctcccgagtagctgggattacaggtgcccgccatcatgcccggctaatttttgtatttttaatagagaaggggtttcaatatgttggctagtctggtctccaacacctgacctcaagtgatccacctgcctcggcctcccaaagtgctgggattacaggcatgagccaccgtgcccagcctggcctattttatttcatgcatatatagtttaagtgtctctgagattcttgatcaactaacaaaatccaagaggcccttttgttatattctaaattcattcctgcttctgattgttgcaaaggggtcagcggatagggtgccagagccagaagttagctaggtggcaggttctgaattaatgtggtattctgggtaatataatgtcatttcctagggaactgccagcatctagctgacctccaagaggacaagtggtcaggaaggtggagatagtattagaactgttattattgttgttgtttttaacaagcagacctgtcatgaaacttgccatagaggtccccttttccatatatcaccaaagcctcataggtaagaaaaggtaaacatccaagattgtttctttaaagattgctgttgggcagaccaagatttagccacaaaaataaacataatctctgatgctgagaagagatcagaatgagttgaaacacaggggaaaaaagaagtaagcagaaaaaaattttacaatagtagatatggggattagatagatagacggctatatagatatataggactctgaatagacccattacaggcaggcatgtaagtggaaatgattaatatatagatgtagacacaggtaattctatataaatgtggaagagcagcaggaagtttctacagctgggaaggaaaaggtaattttttaaaaatgaggtcattacaggttgtttgggtccaggcagattcccattgtcctccctaaacactgcttgtaaacagttttgggactgaatgcaccctttgactgtagtctatgctttacattgactagaactgacaaacagatgaaaagtaaaataatgtttctagagattttctatttggttatgtcatttttttccatggacacatctggctaaagccaaggggtgttaagcccccaaatgtcatttgaatgttcttacagtatgaagaagaggaagaagaaacactttgaaaaccaataattcggccaggcgcagtggctcaatgcctgtaatcccagcactttgggaggccaatgtgggtggatcacctgaggtcaggagttcgagaccagcctggccaacatggtgaaaccccatctctactaaaaatacaaaaagttaggcaggcgtggtgatgcgtgcctgcagtcccagctactcaggaggctgaggcagaagaatcacttgaacttgggaggcagaggttgcagtaagccaaggttgcaccactgcactccagcctgggcaacagagtgagactttgtctcaataagaaaaaaaagaaaaccggtaattctgttttggaactccttgctctgctatggcacatgtatacatatgtaacaaacgtgcacattgtgcatatgtaccctagaacttaaagtgtaataaaatatatatatatatgaaaaaagaaaaagaaaacaacagtgctgattgaggtgtcacacttttgctggttgtctctcctgggtatacctctagcttatcaccgccattctgggaagacaggagcaactgccttttagctgtagtcaccactcatttccctgttagccccttgtggactggaagctccttgaaggagacaaggcaccaagtcacattttacttcatatcccaccaccatgatgtgcctggcacgtaaatgttgaataatctgaacgagtggatccctgaacagtttaataaaatggggtttaaggagactgtgacattcatgaatagcatcacatccaggcttatttctatggctttctattgggctcaatgcctgggtccctggcacatgagaaacaagtatccttgagcagtaggggaaccataccttattcttaccacctcaaaatatctagaactggctgggtgcggtggctcatgcctgtaatcccagcacattgggaggctgaggcgggcagatcacgaggtcaggagatcgagaccatcctggctaacacagtgaaaccctatctctactaaaaatacaaaaaattagccaggcgtggtggcgggtgcctgtagtcccagatactcgggaggctgaggcaggagaatggtgtgaacgtggaggcggagcttgcagtgagctgagatcgcgccactgcactccagcctggcgacagaacgagcctccatctccaaaaaaaaaaaatctagaacctcagcatgaagccatttttaaaatggtgccctatacttagtcaaattcaggcaattcagtttggggaattattttctgtaaatgaggtgctctgaatcagagttctgactccagctttactggctgcctaagtgccatggtttagtgtaatgaaaatacagtggggggtccttaaggcatcattcagggtctacctttaagcgactccagctcttgaacttaatgaactggacactttcaagttctgaacatggtaaataaaagccagcacctgctgccaaaataccttgtctcataatcaaaatcatttctagagccagcggaacatggattccctgagaaattcccactgactcagcaattttaggttgggattttattttagagtcacttaacgaaaagatttcacctagtggcatggccccaatatttatcaggtaactctggccccatctcagcagactgactgattcaatcatcttaccctttactggggatgaaacgaaatgcttactaactcactcctgaccccacctgccactccaagtcattccagcaaacaaatccgtaatagattgctgagagggggaagataggtgaaattggagaatacactaaaaatcaactagttttaaacggtacgggtgggagccatgccccctctgtactggtccactttataaatcccagagggaactcattctatgcttgaaggaaaactttgccttgttctttggttagattgtgctgaacagatcaattcatgtcaaagagcatcaacttttcttatttatgccatggcttccataccacatcacactttatttactcttagtggaaccttgaatcaatgatcaattttgttttgtccttcagtggagtatcagacaccaggacaacctggtcagcaaatattctgaagtcctcagcagttattactagacaggatattagcatatggcacatcatggaattaatttatgtaacacatacttagcatgcacctatcaaatatgtatcaggcacagtgccacggccttaggatggagaagaaaaaacatagttcttgctctcagagagcttagatctagaagttgatagatgctgttttccaagtttctccacttgtatttctgaaactgtgaacagccaactgacatgtagtaagcaatcatttttccagaaaaagtctgttggggtgaaataacatgataagggatctgagaaaagtaggcagggtagggatggcaatggggaagattccgttataaaggaacagcatacatatagattatatcgctgtatatttgtgtctgtgaagcacctcatttaattagatggtatcatggcaactagaagagtgcttacttaaatgagcggctccatgcaaagccctagcagactgaaagtgctttgtaggtattagctgttattattcctactgctcatcactaatatgtagtaggcactccataaaggtttgcgacatgagtgggtgggagatttagtgctgaaatgtaaacctatacataaactgaatatcacatctatatgaatagagaaccttttacagtacaagcaagagcaagatgttcacattatattctgcaaagaatgatctgaacacttaaacttacaggctccgaaagtgtctctctgcccaacatccctatccatttaaatagaaatggcagtagcagcttcctggtgctgctggtgggaagagccgtggtaaggtgtctcctttctttcactccggagcgggggtgatgacaggagagggaccgggcgggagcgaagtgatgatggtgataatgggggtaactgctgagagcgggagggtgggggccaggaacaggaggagtgtgagcgtgagaagacagtgctcagaagccgacacccaggtgacttctctggaatctccctgctctgaaatgggtaacgtggctcctttctctgaagctccaacacttaaaggagcttcttgttttaagcttcttgtgttaagctccagatttttacaagcatctcttcagagcctggtctccaaagccatccgtccagtcagatcaagagctacttgccctgtttctccatagtcacgaactggttaatgtgaggggaaggcaagaatggtctccatcgtcacgggtttctgccttggtttgaagcaagctccagcagttacatgaacaccagttacggaatgtctacagttatgacaagacacagcagggctgacccggctcacccagcaagggaacaaaggccatccacacgtcagacccagcaattcaggtgaaggaacacacagaacctcctagttcgctggatgaggagtcccccaatttcaccagataatcacacaacatgttttcatatggccacatgcccacagcctcaagaaggtgaagcattttcagagaatgattcctgacactacagaaacattgaccatttagaatcagaagaccctcagtcaaggctggcctcacaggaaaatcaaatgtaatgattcccataatgagttcaagccagacaactgaattatgcatctgacattaaaacaactgggggattgtaggaggaggagaagtttgggaagagagaggacagtgtaatcttctgggagtaaaatttattactgaacattaaaaaaagatctgcaagttaagttgagagtcattttgtttatactcgaaatgctacaatgtcctttgatttgtttatgcaagttttaggggacaagttacgtttttttagcatataatctacatttattcccaaaacactgctcctgagacaatccatcagatatttcctcaaggctgtggaaaaggggataaaaggcatatttttaaaggtgggcgtgtatgtgcaaaacatgtttgttttaaagagatctgaatgctgtagaaataattagccatgtgcgtgaacgaaaataatgaataccaaatggtacaatgtcctgcttgaatcctgtttcagaaacagaatgtgaaggaaacattacgttctctcatccctctcttttctctttcacccttgttacccctgaattttgtaataatcactattacccttttggctatgaatttaatgtctctatatatagagccacacccctaacacagattcttcttgcctctcagagacagttaaatgtctttgggtattgcactacttattctccataggggctcagacatattcactattgagcattttcattagctaaaataaattaaatgtatgtcgtaaatgtgcagcaacactgaagaagctgcgagctacatcttgtccttgggagtcatttacttagaataagtaaagactttctcacttgctagtttcaggcgtcttaccttgtgttattccttacaaatggacagggctgttctagaacccacttcctgaatacagggaaagaccccagtggtgtattgggataatggagacagacaggtctgaatgtgaggtgtggacgtgggcttgtgtgtgtgttttctccactggatttcttcaaacctaaagttgctggatcacatttctaacaacaatttgcctgaccttataggatctcctttctcactgaatatgttacgattagaggaactaagattggctaaaggacttttggaatgagccctggacttaaaaacccgttgaagagggagcaaacaagaggaacagtgttttccaagaggcttacttctcttaaattgaaatatagtcatgttccctggctctgagggcactttctcagagcccatatgtttattcaagcatttgcttcgtgatgtgggaggctcagccagtgtaatcccaggcatgagatgttcaaatgctgaatatgttattcaagcacattatttcccattgacatatgtaaatttaaaaataaaataataatgcaaatttacatattgaatcttgggaatggaaaacacatttccgatgtcactgggtatatctgttcccctactttaaaataggactatagagctgttctctttgaagtcatctctgaccatacagtttaatccagtgggcattaattcagattctgggttagtgtcttgtagaagctctccggtgcttctaatattcagcagatattgagaacccatggtctaatccaatggccattcttagtctttctgtttctctgctgcatttaatataattgatgtcttaattttcttctgtcttttttatttttattttttacgtccataggttttgggggaacaggtggtgtttggttacatgaataagttcttcggtggtgatttctgagattttcggtgcagccatcacccgagcactatacactgtacccattttgtagtcatttatccctcacccccctcccaccctttctcccaagtccccaaagtccactgtatcattgtgaggcctttgcatcctcatggcttggctcccacttatgcgtgagaacatactgttataggatctctggggtgtcaatttttctgatgggaaacttctgtggccgcaacgccttttaagcccaagtttttgtcctgcgtccagaaagaatgaggtacacagacatgtgaagggtgaaaaagaagagttttatttagtgttagaacaactcggaggagtggggagctcctctctataagcagatcgtcccattgagtgttcagctctcagcagagaggaggccctggaaagggtggctcctctctgcaggcaagtcattctgcaggtctctgaagcactcctcttagcagagagggtagctcctctctgccagcaggtcatctctgcagctggttgtcccatcgtctccagctatcagcagagagggtactcctctctgcaactggtcatccagtcccattctctctctgccccctttgtccctggccatcctcctgcctgctgtggctaagcccagggcttttatggacctcagaggggaggaagtatgtgccaattggtccatgggtggccatgggtggacggaagaggcaccacgagtccccactctggtcggcaggactggcagcccggcccccagccttcaggccctccctcgcctgaaggtggggcctaattggggactcccctcttttctgccccggaccctgtcttcctcctgctgccattcatggccccggggcttggccccaacccagctctgagatctgagtgggtgcctggaacggagagaggccaggcagtgggcgcagacacatctgagcatgcagagatggggagggtccttcctggggcgcccaagggtgcaggctgcagagacgcccaggtcctgtgcctgggagggttggccacagctgcacccgggagctcccgccctgacaactcggaaggggcagggctcccgcttgttcctggctcctgcctgcttcctggaatgggaggcccaggtctgcagccgtgggtgcggcagctgcagctgcacctgggaaggcagatcctgcctgttccaggctcccccaagagcacagggagactcggatctacagctgcagtttgggtggctgtggccccaagagggcggggctcctgcttgctctgtggagcaggaggcctgggtctgcagctgcagttcaggtggctgcagtggcacgcggagctcccatcccaactcggaatgaacagggctgccaccagctccatggagtatgcagcaccagccgcgcagccagcttgatggcagcagccactgccatcattacggtgttcagttttccattcctgagttacttcacttagaataatggtatccagttccaaacaggttgctgtgaatgctattattttgttcctttttatggctgagtagtattctgtgatatatacatacaataatttatccactcattgattgatgggcatttgggctggttccatatttctgcaattgcgaattgtgctgctgtaaacatgcatgtgcaagtatctttttcataagacgtctcctctgggtagatacccagtagtgggattgttggatcaaatggtagttctactttaagttctttaaggaatctccacactgttttccatagtggttgtattagtctacattcccaccagcaatgtaaaagtgttcccgtttcaccacatccccatcaatatctatcattttttttattatggccatttttgcatcttcgcccttcttgactacttttcctctctctaaccaaaattatggtaggtgtttgctcttcttgccttttgattgcctttcttggatatttctcccagtgtcagcttccctcccgggtactggtgctgcttctgtcaccccgttcccttacctactcttggtcctttcaggagagttcctgtatgtttatcttagagccacgtaaagctaaatgggtcttactatctttattaacgagctttattatctgcccctcctctagcttagcactctgtccattctgtgtatcttattgcagttgtacctttcctattcccacctgagagctcccactcctttggttcaacccagcttccatcaatcattcctcgagccttgccaattttttgtctctcttccatgtttattgtcgctacctgagtctagaccctctgggaactgagctgattggattgcagtcttctgcacggggagccatggtgtagagtggaaagtgtaatggatgtggagttagaaagatcaaattctggactcggttaagcatttaattaaaatgtcttggccaggcatggtggctcacacctgtaatcccagcactttgggaggccgatgtgggtggatcatttgaggtcaggagtttgagaccagcctgaccaacatggtgaaatctcgcctctaccaaaaatacaaaaattagccgggcatggtggcgggcacctgtagtcccagctactcaggaggctgaggcagaagaaccgcttgaacccgggaggcagaggttgcagtgagccggggtcacgccactgcactccagcctgggtgacagagtgagactgcgtctcaaaaagcaaaaaaaaataaaataaaataaataaaataaaataaaataaaataaaaaataataaaataaaaataaaaatgtctcaaacccataggaccttagtagtgcatatttgtctctaggcctgtttcgccacctataaaataagctgcattttataaatggaataactataaatgaatataaatcgatgtggaatttgcataaattccatatagatttgggtttcttggccttatgctgaaaccagcatttgagactgttggtgaaaagaatataaagaggtggtgtggtgtacatattactgtccgtattatggtctgattgtcaccacagtcctccatattagctttttatatgacccctgctttcccaatctagatctccagaatttttttggtgttttttgaatataatcaaaagtttgttttgctcaagattcatcttcctaaaaatgtttgacaaatgcctaatttgaaaattagtttgctgtcttcaagcttctcttaggaaagaaacgtggtccaaaagaagtttgtctagtatgcagggatttttaaaaactggataacccagggtggtctgcataagttatatgcttttcccccaaagaatttcaaacggctttcctggtatcatttgtccttatgtttctttagttccaggacagttcatactgttcttggcagcttacaaaatgagaaactgaggtattgtaattcagtctacttcccttccaaggaaaattgaaaaacactgtggggaaaatactaacaattatgtgagcctcaactttagattctgaaaaatttattcatggaaagcaaaaattcattactattcccataacattgccaacagcaaagagattatattcagaattaaatacagccctgttccatttcttctttgctttgaaactcagtgtgagacagcagtggaaccttttctgacttaaggccaaattaggtcaaaaacctttgctttgaaccttctgagtcatagaataagcagggaggaggaagaaaatccgtgacctgtgccacgattttttactgaggttttgtgcaaagagtgccgtgggcaggaaatgtaggaagaagagaggacatcacttcttcagtgtttccctgtatgtccagagataggaaattcagacatttgctttatttgctaaacttcacagatgtgagcaagaggaatattagaggcaatgtgtctaaattacttacttcgatgtaatgacttcagagctctcaggaggagaatggtcgcggggaaggaacgagcccaaccaatggcatgcccagagtcagcccttcatctgcagttttaagaagtggtggttggagcaagacgtgtttgcagttacaggaataagcaggagagggcagctcaagttgcccatcaaaagggtgggtgaggggctgggcgtggtgcctcacgcctgtaatcccagcactttgggaggccaaggcgggtggatcacctgaggtcaggaattcaagaccagccttgccaatacggtgaaaccccgtctctactaaaaatagaaaaaaattagccgggcgtggtggcgcatgcctataatcccagctactcaggaggctgaggcaggagaattgtttgaacctgggaggcagaggttgcagtgagccgagatcgtgccacttcacaccggcctgggcgacagagcgagactccgtctcaaaaaagaaaaaaaaaaaagggtgggtgagtattcctgcaggaaggggaagattgagcagagaaaaatgtcatccctttcttatccatggggcttctcctcccccaccaagctcatccatcagggtcgacactgctcttgtttgtgtcttcgcttagaagagcctgctagaagagtggcagatgagtcacctgtcactaaaagtaggtgttcttagtgctggggaaaatggaaggtggcagcaaattcctgctgcagttttccgtaaaattggattaccactactggttttaggtgcccctggttttaggtgctctgtatgtaagtttgtgcaaaagtacagcggcatctgtgggcatccaagctgggttctgctctcagcaaactgaagcaagcccaggccagtccaagggaagatggctgtggaccttccttctgttttatgcagcctagtttgaggcagttcaactgccccagagttaaacagttcaccatacataatagaggacttcgtaattaaaataaatacctctccaccaagagaggagaaaaagaaagatgtgcacagtgtgatgcagaaatgcaaggtgccctaaagtcaaatatgttacaggacacagtgtgcagctgtcagggcctctggccagtctccagctatgctggaggtattttctgtgctctgaccataggctacaagaccacatggctgctgctccactctgtagagtttcttgcatatcagaaaatctgagacctgacatttgtgatgaatatttcttgtacccatcacaaatcagaagaacaacccagagaggatgtcaggcacctgttggtctttcctcttgatctacttgttgcctccaagcaactaaggttctttttagagctctcacccctcaaagtgtagataattatattatcctctaaatatctaaaaactttgtttaaaaggactcgattttgttttctgggaaaagcttggtttaatacaaacaaattccatgtgtaacccagctttataaaatagaagggtccgagtgcggtggctgtaatccccacactttgggaggctgaggcaggtagatcaggaggtcaggagattgagaccatcctggctaacacagtgaaatcccgtctctactaaaaatacaaaaaattagccaggcatggtggcgcacacctgtagtcccagctactagagaggctgaggcaggagaatcgcttgaacccaggaggcagaggttgcagtgagccgagattgcaccactgcactccagcctgggcgacagagcgagactccatctcaaaaaaaaaaataagtgaaataagatagaaggaagggggtctggctttattgtggagggcactgttttagggaggtacatacatgaatatgttcctccgtcagggaactgagggtccactgcactgattctcaaccatggctgcacattgaaatcactgatacccactccgaccctataggttctgagttcagtggcctggagtgtggtgtgaccggcaagacttttcaaaatctttccaggtgattctcctgtgctgccaaggttaagaagcacaggtctagtgtagtagttccccaacctagctgccaatcagaatcaccaaaagagatttttaaaatacagattcctaggtcccagcccagacctacacaatcttgggaaactacagaggatgtgtatttttacagcatcacatgtatttctgattatcgactcaggggaccctcactgtaatgtcctcatgcacgattgtgatcttaaagcataatgcctgtagcagtttttatttatttattctcgtagacgaagctgtttttcactgcttcaagtttaatggccaagtgtgtttgtaattgtggttttttgttttttgctttttttgagacaaggtcttgctctgtcgtccaggctggagtgcagtggtgcaatctcagctcattgcaacctccgcctcccaggttcaagtgattctcatgcctcagcctcctgagtagcagggattacaggcacaagccaccatgcctggctaatttttgtagttttagtagagacgggggttttggcatgttggccaggctggtctcgaactcctgaccccaagatccgcccacctcagcctcccaaagtgctgggactacaggtgtgagccaccatgccgggcctcctgtaattgcttgttaagagaatcagacacctttctgaagccactaaccaaccagcagcattccccattctatgagcgcttttcctttctgctttcttggcacatttctgtcatagacctcgttctcagccttgttgagacacctcctttagtttagtgtggagtattttcctagaacaccgcagccagacgtcccccgttatccgcaggttgatttctgaggccaactgcagactgaaagtatgaaatggaaaattccagaaataaacagttcctaagttttaagttgcgtgctgttctcagtagcatgataaaatctcacgccttaccccatcctaacgcagacgtgaatcgtccctttctccagcttgtccgctgcgcagcgctccccgccggtgagtcacctagcggccatcttggtgcttagatccactgtggtgggatggaagtgcttgtgttcaagtcacctttattttacttaatgatggtcccaaagcacttagtgatgctggcatactgttacaatcgttctattttattattagctattatcattaatctcatactgtgcctaatgtataaatcaaactttatcgtaggtatgtatatataggaaaaaaacatagcgtacatagggtttggtactatccagtgggtttcaggaacccactgggggtcttggaacctattcctcatggataaggcggggactattgtactgaaatctgacaataactctgccatgatgcttcttttgagccacaaagggagccctcgatgtgccttgctgtggtcatttcctttaaattcccttgctgtgatcatttccttccatccagcccagcctgagatgtggagactaccagacagagcctcgtgtgatgctctgtcggcttgagtgtgaggaagcttgtaaatccatgcgttttgttaaaacattatcttctacagtgtcattgagggaagtttcaaatcagctgtgaaagaaaacaaaacccacccatctaaggcattactcatgcctggctgttcctggcttgcattagactccctggctggtcccttcaggctctccgttgagagctttctgtgaagttctttgtatattttcccaaatatgtttattatgggttcattttatcttctacgttggaaacgttatagattgagactcagtcactgccttattgctgcttttcatcatcccacccaccatcccttgggttaaccagagcaaaatagaagcaaactatattattcgcgaaactatagcagggaaaaagatccaagtttctggaacgtgtcctgatgaaaaaataagagtgcatcagatgtggagataaaatgtctcaatgttgaagggatgcatttatctacttaacactcagatgtttttctgatggaagcctctgcttatttatattttagcaaaggccaaactaacctgttctaagaaataatctcatactgaaagagagacctcacttcccatttcccaatccaaagtaaatgctgtgaaagaccaggaatgtagtaccgtcagcacacatctgggactgtttgtagcctacgttctgaaatcaggggatgctgacaggctcaagctgcgatactgaaaggaggcctggtttcccttctgttggaattacattacaaggagaaatattgatccagcatactcaagaatgggctgggtgtggtagctcatgcctgttatcccaacactttgggaggctgagacaggcagatctcttgagcccaagagttcaagacaagcctggacaacatggtgaaaccccgtctctacaaaaactacaaaaattagctgggcgtggtggcatgcgcctgtagtcccagcaactcaagaggcagaggtgggtggatggcttgagcctgggaggtcgaagctacagtgagccaagattgggccactgcactccagcctgtatgacagagtgagaccttgtttcaaaaaaaaaaaaaaaccctgaaattaaaaaaacattcactgggggaaaaattggtttcttagtagaagaataccagcaaaactcaaaatgaaaatggaaatgctctgctgccaatcaggaaaagactgaaaatcttggcagaattctgctggaatcctctgcccatttccttcatgttctcataattataaaagaaaaagaaatgaacattgataaagttcctgctgaataagagaagttttttctacctcacatttgttgaatgcatctcatttagtcatcaccctaaccctgtagggtacgtgttattatctccattttctttattttttgagacagggtcttgttctgtctcccaggttggagtgcagtgccgcgatctcagctcaatgcagctttgatctcccaggctaggctcaagcaatcctcccacctcagcctcccaagttgctgggactgcaagcatgcaccaccacacctgcctaaatttttttattattttgtagagacaggcctcactttgttacccaggctggtctcgaattcctggcctcacatagtcctcctgcctcggcctcctgaagtgctgggattacaggtgtgagccaccacacccagccaattcccattttaaaatgaggaaaccaaggcttgggttcggtgatttgctgtgactgaaaatccttccctccccacaaatagggacaccactatcagatatcacatagatcatttcccaggagccaagggcaaagggcagacccgtctttggccaaagccaaattctttcctacacagtaaatatgggaaaaagagagacttcaagcttcaccccaagagttgagacattttgaagaaagactgacacaattaggggagtcgctggatataggagtgaagtgcgagagaggtatcaaatatcaggctctggcctatgcttggagaaatggtgcaaaaccgttagcagaaatatggaaccggagtgcatgctgatttgagaggggtggtaagcatccaagtggaaattcctcacagactcttgagctgagactgaagttcaggaagaagaacacacctggattttttttcttatgctaggcattatagttgcttttatttcatctcaacaatcttttgaaaacgtattatcatcattcacatattccagatgaggaaactgaggcttacagaggttaactgcatcttccacgtccacagtgctagtatagaaaatgagctttgttgtaaacaggagactgccttactttttttgcatttccgcttgtccattaaatattttattgcctgtttagattacagtcattggtgcctacagcagcattatttatctttcattgggaattagggccttaaattaaatcgttagtcatattttatgtttttataatgttgtagagattctagttagggcatggtattctaaaaaggaaaagcattgatttaatttataatgaataattgtatctaaacagtgtactatgtgttctgcgttcaaataagccagaaagcttctatttataccaaaggaataaacagcaaacaacagacatacttaaattgaaaacatgagcacatttgaattttatttttgaatgtagatgtaattgaccatttgttctgcaaacaaggctttggtccagtttagggggaaaaaaaaatcagtgcactagtgtggagtattttctaaaagaagacaattttagagacttagtaaactttctgaaccggtaagacttgaaatgcctcatgaagggaagtgaggcagggaaacttttaatgagagattattccattcaccatctttgctggagctgactggtgtctatgatgcaggaagtaacctgagaaagaattctagggaggaaaatgtgttttttttttttctttctttcttttttgagacacagtctcgctctgtcaccaggctggagtgcagtggcatgatctcagctcactgcaacctctgcctcccgggttcaagtgattcttctgcctcagcctcccgagtagctggaactacaggcacgtgccaccatgcccagctaatttttgtatttttagtagaaacaagatgtcaccatgttggccaggatggtctcgatctcttcatctcgtgatccaccagcctcagcctcccaaagtgctgggattacaggcgtgagccaccatgcccagcctgaaaatgtgatttttttatgcagatgaaaataggaccacagtgaaggaggtagagaagagggcctttcttagaaaataatcggaacaaccacagccagtaattgtaggtcttgagtacgccaggccctcatctaaattcttcttatgtgtgaactcacagcaagcctgtggggtaggaactagtattattcccactttggagatgagcaaactgaggcacagagaaatgaattagttaggcctggttagtacttagatcagagaaattaattaacttgcatcagatatacacagctgaggagtaaggccaccaggattccaaatcaggtggcctagatcccaggcctgtgctgtttgctgcagcagtcataggaggtagtttgaactggaaagcagttcatcatgagaggtagcattttttgaggcactactgcctgcttgcatgctaggcactgaattgtcccatgcaattctcataacaacttcatgaaataaggcgtattactatcttcatttttttttttctaaggcagagtttcactcctgtcgcccaggctagagtgcaatggtacaatcttggttcgctgcaacctccacctcgcgggttcaagtgattcttctgcctcagcctccctggaattacaggcactcaccaccaagcccggctaattttttttgtatttttagtagagacggggctttgccacattgaccaggctggtctcgaactctggatctcacatgatctgccccccctcggcctctgaaagtgctgggattatatgtgtgagccaccgtgcctcgccatactatcttcattttcttaaagaggaaatcaaagcttagaaagttgaatgggcccggtgctgtggctcatatctgtaattctaacactatggaaagccaaaatgggaggatcgcttaagcccaggagtttgagaccagcctgcacagcgtgatgaaaccctatctgaataaaaaagtttaaaatgtagctagatgtggcggcacaagtctgtaatcccagctactaaggaagctgaggatcacttgagcacagggaggtcgaggctacagtaaactatggttgtgctactgtgtccagaattaggtgcgttcttggtctcactgacttcaagaattaagccgtggacccttgcggtgagtgttacagttcttaaagcggcatgtctggagttgttcattcctccctgtgggttcatggtctcactggcttcaggaatgaagctgcagacctttccggtgagtgttatagctcatacaggcagtatagatccaaagagtgaacagcagcagcaagatttattgcaaagacaaaaagaacaaagcttccacagtgtggaaagggatcggagaaggttaccactgctggctcgggcagcctgcttttattctcttatctggccctacccatgttctgctgattggtccattttacagagagcccagtggtctgttttgacagggtactgattggtgcatttacaatccctgagctagacacaaaggttctccagggccccactagattagctaaataaagagtgtcgacacaaaggttctccaagtccccaccagagtagctagatacagagtgtggattggtgcattcacaaaccctgagctagacacagggtgctgattggtgtgtttacaaaccttgagctagatacagagtgccgattggtgtatttacaatcccttagctagacataaaggttctccaagtccccaccagagtagctagttacagagtgtggattggtgcattcacaaaccctgagctagacacagggtgctgattggtgtgtttacaaaccttgagctagatatagagtgctgattggtgtatttaaaatcccttagctagacataaaggttctccaaggccccaccagactcaggagcccagctggcttcacctagtggatcttcacagaggcagtaggtggagctgcctgccagtgccgtgcgcccgcactcctcagtccttgggtggtcgatgggactgggcgctgtggagcagggggcggcgctcgtcggggaggctctggctgcacaggagcccacggaggggcagggggaggttcaggcatggcgggctgcaggtcccgagccctgcccgccagaaggcagctaaggcctggcgagaaattgagcacagcggctgctggcccaactgctaagcccctcactgccctagggccggcggggtccgccgctgctccgagtgcggggcccacggagcccacagccacctggaacgcgcgctggcccacaagcaacgcgcgcagcccgggttcccacccacgcctctccttccacacctccgcgcaagctgagggagccggctctggccttggccagcccagaaagaggtcccacagtgcagcggcggggtgaagggctcctcaagagccgccaaagtgggagcccaggcagaggaggcgcagagagcaagtgagggctgtgagggctgccagtatgctgtcacctctcactacactccagcctgggtgacagagtgagacccggcgacaaaaaagagggagagaaaattgaaagactttcctaaagtcacgagttatcaaatgccagttagcccggtctaacatgacactgaatcaactatgtgcttcctgctcaggagtcagaacgatattatcaagtgttaatgcttctaaatgcaaagagggagcaaggtgtttcttctctttagtctgtgaccagcagctgctcactataacctctcttccactgcatgtccaaggattactgcatagaggaggattcccatcttcccagcccctaaatttaaaaataaattaaataggctgagcgtggtggctcagggctgtaatcccaagcggtggctcactcccactttgggaggccgagatgggcggatcacctgaggtcaggagtttgagaccagcctggccaacatgatataaccctgtctgaaaaaagtacaaaaactagccaggcatggtggcaggcgcctgtaatcccagctactcaggaggctgaggcatgagaatcgcttgaacccaggaggcggaggttgcagtgagctgggatcacgtgactgcgctccagctctggctactgtctcaaaataaataaataaataaataattaaaagaatatagaaccgccctcacacttcctgccggatgcagtcaatttgacagtgtgcctcattcagagggtgttgcctacatccagggagtgtcaatttttttttattgaatgaatacctgattaagttaatgacgctgagctgggggaggaggagcagtttggcagcccaatgctgaagggcttctggcagctcattcagtgtccttaatgttccattggctttgtgctgggccgcatgtgagccccaggagaggctgctgtaattactcagcttttttattgaaaacagctgcaggtagcgagtcatcccattgtccatcttgctagtgactggaaacaactcggggccatcttgggctccactacactgcagcctcattctgaagtcagtggaggtagaaagtaggcttcccacttgctgggcttttcaaaatgagccattcatcttttgagggtcagaagtcagccacccattcaccgagtgtgagtcatacccctaattttaaaacaaacatttattgcagagagaattcttatcttggccgatgtgtacagctgatctccttgtccttcctacgattgatttaggctggtttcaacaaaattgttgtctttgtaaatacacacctcttccagtaaatccagagactaccgaggtgtttccttgagattgagcctaagacaatctttaattagttttggataattggatatgaatgtttagaggccttcccatatagcaagtgtctttaacatctcacacaatatattatacttgtacttcctgacccgagaagtaacaggagttaataatctcacgtgagaaagtatgtttgaaatggaatctcaaggggcagattctttgcagataccacaacattattttatgtccctccgtaatgagttcagttttttatcatcacatccaaaatctagaaaatgatccagaaatcctttgccttttaataaccagcttgtaaggaagacaaactgcaagagatggacacaagataagaacagtaaccaaccaaggacggacagcaccctagaaacccaaggggttgtgaacttcagtctctaagcagcatcggagtttacggtctaatgacgaaaacacgtgaaaacaaggattgcagcagccggaagtggctttgctgagagtttaggaatgattgcctaaggaagtagcagttaggggacccactgtattagtcagggttctctagacagacaggactaataggatagatgtatatatgaaggggagtttattaaggaatattgactcacatgatcaaaaggtcaagtcctacaataggccacctgcaagctgaggagcaaggaagccagtggttgaccagtctgagtcccaagacctcaaaagtagggaagccgacagtgcagccttcagcctgtggccaaaggcccaagagccctggccaaccattagtgtaggtccaagagtccaaaagctgaagaacttcaagtcgggtgttcgagggcaggaagcatccagcacgagaaaaagatgaaggccagaagactcagccagtctagtccttctacgttcttctgcctgctttcattctagcctcactggcagctgattagattgtgcccacccagattgagggtgggtcttcctctccaagcccatgacccaaatgtttatctcctttggcaacaccctcacagacacaaccaagaataatactttgcatccttcaatccaatcaagttgacactcagtattaaccatcatgcccaccatggtgaaggcatgcgggggtggctggtgttagactaattggagccttggaggatagtcgaggaaacggttcctgaacggtgtgtggatgagaatgttggagcagggtgctaaggaggcacagaggagaggcagagggtatggggttggagtggggagagccttaaggaggtgacatggaaggagagacctgaaagatgggtgaggccagtgcttctggaagtgtggttcctggaccagcagcatcagcagcatctgggaactccgggtgaatgtgatgcgcacgctcgagtataagaaccactgcattagaaaacaggtgacagtgccttgcggaggagcggtggctggtgtggaaagtactctaacagagcagagggaacacatacccagaggcctgcagcaggcatatttgaggcttgatcaggacacagccacccacacccactggttacaaattatctgtggttgctttcagcctgcagaggtagagctgagtaatggccacagaggtgtatggcccgcaaagccacacgatttactaggtggccgcgcatcgtcaaggttttccagtccctgattcagagggtggaactgacataacctgatgacagaatcaggggagaagaggcatacagggatatcggccagctttcagtcttcagtgagcaatgacatgatagagcagtgacactaagatactgctgcctcactttttacagctcacagtcccctttgcggatgtgagaaagggcatacagctttaagggcttaaaggatgccctgacgtccagtcctggaatacaggctaatgccagcaggtatctcagagatccttgtagctccaagcagatgagggagcggggcgctgtgtggtttcaaaacagaaatgcagtttgttcacaaacttttaagatcatgacatatttatttatttatttatttgagacagagtctcgctctgtcacccaggctggagtgcagtggtgcgatctcagctcactgcaagcctgcctcccaggttcacgccattctcctgtctcagcctctcgagtagctgggactacacgtgcccaccaccacgcccggctaattttttctattttttagtagagacagggtttcaccgtgttagccaggatggtcttgatctcctgaccttgtgatctgcgcgcctcagcctcccaaagtgctgggattacaggcgtgagccaacgcgcccagccatgacatacttatttttaaaaatttttgactggtgacaaaatatgcataatatgaaatttaccatcttaatcatttttacgtgcacggttaagtggcacattcttgttcaaccatcaccaccatctgtctccagaatgtttccatcataccaaactgaaattctggaaccgttaaacaactcccattgccccgtcctcccagctcctgctaacgcctgttctacgctctctccaaatttgactattctagattcctcatagaaggggaatcatatgatattgttcttttgtgtctggcttctttcacttagcataatgtttgaagatttatcaatgtcatagcatgtaacagaatgtcattcctttgtaaggagagggggatgaataatagctcgtcataaggatataccacatttttaaagtttattcatctgttgatgatcattgggttgttgacaccttttggctcgtgtgcacaatgctgctatgaacacgggtgtggaatatctgagtccctgctttcagtgctttgtggtagatatccagacgtggaattgctgagtcatgtggtaattctgtatttcacattttgaggaactgccaaaatgttttccatgcagctgcatcattttacgttcccaccaacgatgcacataggttctcgtttccccatctccaccaacacttgctattttccatttttgttttgtttttttttttaaaaaaaagaatataatgtccatcttaatgagtgtgaagtggtgtctcattgtggacatagcatataattttaagtatgattaaaggaggttagaacacgacttttgtgttggcaaagtggggaaaaggattggctgctgtaattaaaatcactgagacaggccgggctcagtggctcacgcctgtaatcccagcacgttgggaggccaaggtaggtggatcgctcaggtcaggagtttgagaccagcctggccaacatggtaaaaccccgtctctaccaaaaataaaaataaaaataacatagccaggtgtggtggcaggcacctgtaatcccaactacttgggaggctgaggcaggagaatcacttgaacctgggaggtgcagtgagccgagactgcacccattgcacaccagcctgggtgacagagcgagactccgtctcaaaaaaaaaaaaaaaaaaaaaatcactgagacatactgccaaggacagatggagttagggggcttaaagatcctctataccagccgggtgcggtggctcacgcctataatcccagtactttgggaggccgaggcaggcagatcaagaggtcaggagatcaagaccatcctggctaacacggtgaaaccccatctctactaaaaatacaaaaaaattagccaggcgtggtggtgggtgcctgtagtcccagccactcgggaggctgaggcaggagaatggtgtgaacccgggaggtggagcttgcagtgagccgagatcacgccactgcattccagcctgggggacagagcgagactctgtctcaaaaaaaaaaaaaaaaaaaaaatcctctataccagaggttctcacctctggctgcaaattagaatcccctggtgcatttcctaaaatgccagtggtggtcccaacatctagggattcttattcagttggtctggggtagatctggacattatgtttttaaaagctccctgggtgagtctgatgtgccgtcagcattgatttcttattctgcaggtgagagagtatggccctagtactaaggctgcaagggttctggtctctcagccagagctgctgccactgatacaccattattcagcatgaccacaaacacagtgaaaccagtagtgtcccaggtacatgtgcatcctcctttgtattgtggaggaaatatgtccccaaaatctgcagagccaagtgcgggagccaactcctccatttggtctgttgggatgttcagtattctatggtagatttctagtaagtcaatttcactcagtgggctgaggatattaagacaccggaagttagctgatgtgttcccccattgctccaacactttgaactctgtaccccaaaaattgatccactcagtgcttcttacatgtatgtgccattggggagatttccacagggaggctttctctgagcctttggccctggtgacattacactgagtaatatatatccctgttcctttctgtaccacccatctgcctgttccctggccacagtttggggtataccaatttagattaacctaattattgtttcacaaggcattcttatcactgaacgctgatggatgttacttcaacgttgttatattttattacttggcctatttaagtgtataaccatcactagctataagaaggtgaccaactacaacgttagagagagcagtgcctgcaccacgaattgcaagttcagggggtttcccagaccaccctccgttttgataattcagtaaaaggactcacagaactcactgaaagctgttctactcatacttattacagggaaaggatacaagttaaacttagccagggtaagaggcatataggagaggtctagaggggtccagacatggggcttctgttgccctctgcccatgaagtgatgaacagcattacctcctcccagccatgatgtgaagaatcaccaaccagggaagctcacgcgaacctcagcatctagagtttttattggagctcaattgctactgtcctcatgactgacctctagtccctaggccctcctggagatcaggcaaatatctttcattattagttcctctgaggttggaacgtatacctcatggcccaaagcccccatcataaatcacattgttactccatccagtggccaataaacatacttctgtgaggcaggacattccagaggccgagagatcacctccccacaggtgggggcaaaggccagacctgagtttgggtgaggttaaattcttcatggtcaggcgcggtggctcatacctgtaatcccagcactttgggaggccgaggtgggcagaccgcgaagtcaagagatcgagaccatcctggccaacatggtgaaaccctgtctctactaaaaatacaaaaattagctgggcatggtggcatgcgcctgtagtcccagcttcttggaaggctgaggcaggagaatcgcttgaacccaggaggcagaggttgcagtgagccgagatcacgccactgcactacagcatggtgacagagtgagactccgtctcaaaaaagaaaaaaaattcttcactacacactaatgacccactacacaacccaagaactagatcccaagttttcatattaggattttttgtgtgttgtttctgcccttttttagccatgtaatcttaggcaagtgacttacactctgagcttcaatgtccttgtctttgaaatggggtgatcatatgctagttgttatttatatgtaaagcattgctgtagcctgcacaaattaagcatcgtgacttgtcctgcctgctgtgccttagagagcctgggtcccgggaggtcttggggtctttgcagttgagagcattgaattgtgcagtgtctcagtgactgaaaccaccatagaaggtaagccagtgtgtgacacctggaggaacagctggttagtttatgaattatctggaggcattggctttgctttcattcagccacaccaaggacagtgaatagttttaagactctcccagagtacctcagttcccacgagacctttttcctgacttgatggagagttttatgttctctgttgtagactggggctgtctaatgtcctggaaacccagccccctggtggctggcaggatccagcctaggcctcctggagcagttgctggcgctttgcatcgtgttgtgtggtgaagctcgtgagtgtgtgtgcgggtagacagctggcagccttccctgcgggatgtggaaggaggattctgcatttccccaccatgcgtcttgggaattactcatccaaaaagtattgtggaaaagcaggcagagtgaaacacggaggcattgcacttaacccttccctggaaatgccatccttgagtttagcgtctgagctttctgtttattctgcttgtgtgctgaattgccttccttcttgttggtgtgcataggggtctgcacattgggcacttataaatattatcccacctatcaagtgaagaaaaaaatgaactctcaaacacccatcacttcctctttttctatcacagatgtgaggaaaaaacagatgtttgaaagaattgatagtttgaaggtgttgtattgattacatcatggccaggagagatgagcaacagataagtgtgggtgatcactgagaattcatgaggaaatgtttattgaattataactacgatggcgaccatgtactgagtgtgtgttatactaggcactgtgcatgttaattcttccccattttaaaggcagagattacaactttacacattgttgaaatgaaatttttgcctcattaaacttgggcacatgtataatcgcaagtaaaattaaaattattattttgagatggagtctcgctctgtcgcccaggctggagtgcagtggtgtgatctcggctcactgcaacctccgcctcctgggttcaagcgattctcctgccttagcctccctcgtagctgggactacaggcgcctgccaccacgcctggctcattttttgtatttttagtagagacaggatttcactgtgttatccaggatggtctcaatctcctgacctcgcaatccgcccgcctcagcctcctaaagtgctgggtttgcaggcatgagccaccacgcccggccaaaattatatttttaaaaatggataacataggtggtttggggtaaagccaaggtttgaacctgttctctaccttacggcgtagcccactctaactacaattctgtgtgtccttagtagtaatagcagtggaatattattgatctattatcatcattgttagtaataataatattaatatttatcttgatattctaaataggacagtggatgtgaatgcttcatgcatcgggtagtgagatctatcacagtggtggtaagaaacattcaagtgagagtcaaagtgacaggttctcatcctcctgaccccagttcttactgtgttaccttggccaatacttttcatcttcttgcatcagtccttgaaataagataatgaagagggctcacttcctctcactttgaaacaagttagtctggactgggatgagaaccactaactccaggcagcgtggaaagcatctgtgtaactgttcccagccttcaaccagagtggtggataaacagaaacgtgggtgcccccgggtagctaacctggaatgcactacgctttaaagcaaaaaagtatttgcttctgtattgaatcaggaaaggtcttgacagaaaggcatttccagcttttcttaaaaactccaactcaacctctgtcagacaattcatttgggaccagcttggatccagatggttatttttccatcttgagcctttccaggaattccggcatgggcaggccgccagagacactggctacacagccactgcagcgcgttttccatgtgagccggcttctagggatggcccagccaagctgtggccccgcccctcctccttcctcatccaggctgatcctccagctctcacggacatgtgccatgagccacgcagggggaccccagccacatggccgatgtcctgatgtttccaggggtggcagagctcactaactgcacccccagaactgtcatctgctcactacgaatagcaatggcagaagccaggaatctaagaattgatgaagcctggccctccattatgtggacaggtagtagcaaatcactcagccccacttagggataagggagacagcaacttaaccacgtgccaagcagacaagttcagcagaatggcagccagtgcagctgtgtgtcttgaggaattctttccagcctccccttcaaggcccttaatcaaagaacaactccccactggacgcagagctacccaagccagcgaccacccgaatgagactattattttgggtggatttaaattttttaatcattgcttcaagtatagtcgtatccattgcccaaaaagtctatagatgcatggggtcaaaaaacactactattcgtggtgctgataatataagtagtggggctgcttttctcctgcctttgcttgacccactgcagtcccagctggcagtggtagtggcagattcccctgacccaaccacccccaggaaggtcttgcctcaaagaaaaggaaaatgtggtgtgtgctgctggctgccacggactcaggggagcctgtgccaggttgcaggcttgaacttgcttcttgtgacactagagggagagagcttgtttcaaaagcatgttagtgctctcagttcctcacgtccgacctgtgccagaggctccttctgcagtctcaccactcctatggcctggatcacaattgggtgggtggtcttgaacttggctgctgagcctgaggtcccctgcttgcttgcctgggaaatacaaacatcctgacctctcttccttggtcactgatcagtctcttccttactgaacgtctcaccagctgcagttcttgattagtcaacatggtgcagaggtcccctagacatcttttcccctacttatccctgtgcattctgtcccttttctacatgaaaaataaataggcatatttgctatgaggctgccatcgccatagccaggaggtgagtgtaacccgcatcatggttgggtagactaagaaagtgatttccagtgctagttctacctctgactgtatggccttgggaaaacctcagtgtccttatctggaaaatggagataataatacaaacctcacaaatttgttatgaagagtaaatgagatatttaagtaaggttcttggcatgtataataagtaatcaataaatggaagatatttggattggtttcttagggctgccataataaattaccaaaacatatcgtggcttaaaacaacagaaaagtattctctaacactcctggaggcttgaagtctaaaattaaggtgctggtggagccatgttcccttcataggctctaggggataatctttccttgcttcttgctgcttctagtagcttcgggtgatccttggcttgggactgcgtcattccagtctctctgcctctgcctccacagggcctttgcctctgtacatctcacatctttctctgcctttctcttataaggacatttgtctttgaattgagggcccacctggatcatccagcatgatctcatttccaaatccataattacatctgcaaagaccctttttccaaataaagccattcccaggttctgagtgggcataacttttagggatctaccattcaacccactgtccttccttattcatgataaaaattaagatacataaaattatttattttttatgtccttaggccctcgtgtggactccttctagcttggattacgagctttcatttcttgctttttctcttctcactcactacacttccgtgaagagcaagatcccatgtcccaggggtgcagagccgagaagggaaacccgagcgcgttggggcgaggctctcagacagcatcttctacaaagttgtgccaggtcccagctcgcctctctggtggtttctggcctggatgtctctagacagggccttcagtccccttcaggagcctcctcattttgggccaagaggcctgccccatgaagctccacgcttagatagacatggaagagaaggtcaatagtcagtttccactgaggacacagcaagaagaaattgtgacagtagactgggatgacaagccagccaccttgacacagagtggaatcacagtctcagaatgttcctaatggcaaaaaaatgtagagtaagtagttcgaacacccaaccagggcagggacccctaccccatatccctgagtttctatcctgacccttggggtgacccagagatccctgactcatgaggcagcccagtccatttttaaccattctcattgcttcctaatgctgcagctttttctgttcttccccagggcactcattcccagttgtctcagctgttactcatctgcttgcctccagacctcttgcgcaactgatcactccccctagacatgccccatccttcccacgtgcctttgcagcaggatttcaactgtggctttacccgtgccatctatggttgcagtatttattcccttattctgaacattgttttctttctcttttcttgagacagggtcttgctttatcacctaggctggagtgcagtggagcaatcatggctcactgcagcctcaacctcctgggctcaagcaatcctcctgccttagcctcctgggtagctaggaccacagatgcaaaccaccatgcctagctaattttttttattttttgtagagacaggatctcgatatgttgtccaggctggccttgagctcctgggctcccaaagtgctgggattacaggtgtgagccactgaacccagcctgaacattatattttttttaatgaaggttataattactatactttttaagaaccctaccaaatggttgttcatattgagtgtatagtcaaacaaaaactttctgggctctttcattgaaaccattattaaaccagatctcttcaaccctgctagtaggctaattgagctgttgaaaccaagggcaggcatttacatttattctcattgatcttaattttcctggtttggtaccatcacttccggcttcttaagatatatttgaatcttattcgcaacatatatcccttctagccttctgttacttcgaaatatgataaccaaaacactgtattagtattgaatagaacagaactaaaaatagagttctggcataccatttgcttcacactgacattgaacaattgaggtccccgtcatacatactagaaacggaatgagtgtttgatgaatgaatgtgtgatccactttgggggcatgcctgttcagtcaaccataaaggcatctaattatagctatcatccaatccacctttctccattctagatactccaagcatgtcgggtttggacctgtttttaatgcttggccaaaatgaagtgctttctgccagtgcaccacacaggccttccagtttagtgatgtaataaagctggaaggagattggtgagtcagcactttgagaatccttgacatgcccaagtaacctctgtcctcacacccaggtattctgccctcttcagtgtttgcatacgtagtttttccagtcctggcacaagctcatcagcctgctcttcctcttctttaaagctgaaaccgtgccctgtttgtccatagatatacaggccaggcagccatgggttcattcaaactgagaagcacaggattgggggtgtaggaaaagcaacccattttcttgccctaggtttaagatgtatttttaggagtttatatatcaaattctaagagcatcttccattctgagcagttggctgctatttactggacttgcagtcagtgggcatatattccccacatccctagcacagaagcatctcattttcctatcacttcccaagcagtctgaatccatggtaatagcaaaaaatttctcgaaatgaaattatagcaaagaaagaagtgtggagcttcctttgttaaatttcatttttcttcctgggaatgattgagttgtgtataaaatttatgataatagcctttttaaagtatatttctctgcagttgtgtaaagaaccagaagaaaagcagcatttgttatttgcagccgtattaggtttagatgaccccagaggaagcagtggagcatcacctaaatattagatgtttatctccgaggctccatcaactctgtgtttacgtacaacacctagtttggtttcccagtgcctgctccattaggaagaggctagagatgtttaatttgcttaagagtttagcagtagaaaatttaatcggatagctgctagggtttctcaaaccttactgtgcatagaatcatctggatatcttgttaaaatgcaggactgggtggggcctgagagtctgcatttccagcaaacttgcagaggatgctgatgtcacgggtcggaggaccacacttcgactagcaaagccttataccactgggctaaatttagaaattatgatagagagatagttaatgtagctctaaagcggcttaagatgaatgtattcagaacagtgattatcaggcaaaccatgggtagcaaactctaaatacatttgtcttgattcatctattaactctccctccaatttcccttttccaataggaatgtttaaacagtgcgatctgcatatgtggctctctggtaatttggcattgatataattgtgcatggccccatgtttggaagaaatctttttgttgtggcaggtgcttccagagataaactcctcgggggtcccctgggagggcaattcaggacacagaggccagttgtctgcaactagagactctaagagcagaaatcccactctccttttttcttttttcttctttcgtttctttttctctcttccttattttccaaatctacttttccaccttcataagttacttctttgttgtttagtcccatgatcacccgatagaccaggaatgtggtgccatcctggggcgccctctggtggttcattgaaaatacagcaagacccaatctctacccgtgggtttccccttatcagtactgaaagcttacggggcccagagaagggacacatacctcagcgttagagagccctgtctgctccgtgctgcactggtaaatagccctaaatgtaggaggaggatgggtggaaacttttatcggtttggccccagctcgctgcaactgctgtcttaatcattgtgtccttgatttctcattggcaatctctggaaaagatgctgtttatcaatggataagttttcagaagaataaatttggatttgtgtgttaaggccaatatgtcttagcaatcatttcgcagaagaccagtccagtgagtcttcagggctgactaagccgatgtctctcaaataaacagtataattaaacctgagcactactgagaaccaagtcagcattctttttcaaatttacgaaagctggcttcctaaagaagtaccttcagaggagttttctagttttgtgtattgtgcattcaattgtacaggcaatgttacatttgcattgctaatagacccttcctgaatgtgtttgacattttacttggctttgaaaggacttttatgccgctgctttttcttccctagtgctgccttgggctaattaacctattcccttactggctgggcctactatatgcaaatgttctcattttgcattctgacacatcactcttgcataaatatccctcatgaaaccctgtggggttttattggatcagtgctgcaggagggccagcagggggcgcatggactggttctctctgagtaggtctcacgcatgagttttccttgctcgttggtatggaaatgtgggagcgtttggcattccctttcttaagagtgagtcttgaaatttaaagataaaagttcattattagaacttctttttacaagggaaggctgtacagaacacagttatttgtcacttacaaaaaccctaggtgggcagggcgcagtggctcacgcctgtaatcccagcactttgggaggtagaggctggtggatcatttgaggtcaggagttcgagaccagcctggccaacatggtgaaactccgcctctactaaaaatacaaaaattagccaggcatggcggcagccgcctataatcccagctactcaggaggctgaggcaggagaatcgcttgaacccgggaggcggaggttgcagtgagccgagattggcacattgccctccagcctgggcgacagagtgagactccatctcaaaaaaaaaacacctgggttgcgagagtaaataagtgacattactccttcaacacttcatttcttcagcataagtgttttagggtttttttaaccttatttttcatttccgtcccagtctttaagcgcctctcttgtcatatgagaaattctattcttactgaaatgtcctttgatatcgagacaccaaatttctaaacctgcaccttcctagatatctgatcaaaatcattaaggattgagaactttctgttgtatcatttgtcatttcattatgatgttcattgatgatgttggagcaaaaccaataagggccattaaatcattgccccttccaagctggctgcagtggctcatgcctgtaatcccagcaccgggaggccaagtgggtggatcactgaggcctgttcaagaccagcctggccaacatggcaaaaccccacctctacaaaaagtacaaaaattagccgggtgtggtggcgtgcacctgtagtcccagctacctgggaggctgaggtgggaggatcacttgagcccaggaggcacaggttgcagcaagccgagatcacgccactgcacttcagtctgagcaacgaagcaagaccttttcaaaaaaaaaaaaaaaaaaaggaaggaaggaaggaaaaaaatcattgccccctctaaaaaatagttacaaagtagggggcagagtagagaaagggggttatgtttcagtagggatttcagtgttgctccaacatggacaaggattgaatgctgaaggccgctactttattgtgtttgttttaaaatcggatcattggctacacacagtggctcatgcctggaatcctagcactttgggaggccaaggaaggaggatttcttgaggccaggatttcaagaccagcctggttaacatagcaagaccccatctctccaaagaaagaaagaaagaaagaaagaaaatcagatcattgaaaagagggtctggatgtgagataccaaaacccaagggtgtggaattcccaaagcccaatcccacagctctcagaatcacagcatgttgcactgtgcatacctacagctgctacctgtggaagcaatcacatccgctgcttgctagcctgggtcatgtcagttccactgatatttggcctcttgtctgttgggcattggtttgcccacacagcagcagtaactcagacttcagtggttagtaagagactgagatacttgaccataagaactggctccagggtcaccatttgtatgtccaggtttgaacacactgatctgatttgtctgaaagagctgtcgtctctagtgttaatggcgagttgttactttccaatgagaaaggggacggtgtgaaggggaacttcaatgacaacttgaaaaggaagagagagatggacaaaccaagcatgtaacccactgagaaaacattcagtgcactagccctatttttgtatggtatttgggttttttaaccataatcaaattcggtttttaacagtctcactccgtcatcatatgagtggctgtactgggaattcttttgaaacttgcagagaacaggattatttctggcggcctctgctgagttggcgtgtgtgtgtgtgtttgtgtgtgtgtgtattagggagaggaaatcgtaggtccagtgtggacccagagctaaggggaatcttggagagtagtggctctggcagatgaggattcagaaatcgagtgcaaggactgttctggactttcactgctaacctgctttttctcagtgcctggctctgagggcagggtccagctggtgtcatgctctccaagggcttcattttatgttccagccaggcaaaggagaggtgagaaatggaaccaacatttctgaaaaggaaatttaagaactgcatcatctgcccttgaagaagaaaaggagaaaaaaaaacaggagagagggtattgagaacatcttaggggagttgttaactccattaaaaaatatatgtgttacagtgttcacttgcccagtgtcttcataatcttcctttataatgtgcagctgccacggctagtgtttttgtttttgttgttgttgttttgtttcgtttttggagacagagtgtcgctctgttgcccaggctggagtacaatggtgcaatctcggctcactgcaacctctgcctcctgggttcaagcaattctcctgcctcagcctctcaagtagctgggactacagccgtgtgccagctaatgttacaccaggctaaatttgttttttattttttatttttggtagagacggggtttcaccatgttagccaggatggtcttaatctcctgacctcgtgatctgcctgcctcggcctcccaaagtgttggctagtgttttctctgcttcagtgcttggggtatgattgggttatgggagttcacaccgagtccagggcctagtcttaatcttgccaaagatgttctttccccggtgctcatgttctgatgtcctttccctccttccctttctcctccctttccttttccctttgtcactgccctcttccctttcccagcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtaacgttagccagggtggcacagggatgggacaccacaccgtgatgccatcatcatctcctggcaagacgaattgcttctatgaggcaggattaagggttctcgggtacacctagaccttagactcggcctttcccaactgcgttctctagaaaaaataagccccatttccccgtgatctctgctgtgtgtaatgaattaacctccatgcatggagagtggggctagttatggagtccttgagacaatccagaaactcaccactctagttattttttgaattctgtgattaagatgaggaaccctgattaggaaacgctgctggacttcaggtccttctagtggtcattcggcactttttcttaccaggaaaagacagaggatgccgttggagtgaggggattagatgctaaagcaatcatatcccattgcaacatccatgttttaaaatatgtcttattagctgggtacagtggtatatgccttcggtcccagctactccagagactgaggcaggaggatcacttgagcccaggagttcgaggctgtagtgagctatggctgaacctgtgactatcactgcactcaagcctgggcaacatagcaaggcccggtctccaacatatatataatgtcttattatttaggtatgataaggccaacagatagatcagcagacaactctctttgacgagataatttttatactctctgatcccaagaggaaagggcactctacaccaagaggtgtagaacaccgtaaagtggggggcacctggggaagccccaggtgggtcaggaggtggagggagtgaggggaaatgtggcaaacaacagcctttattgtggtttcatgggaggcagggtaaacgggtttaggattggttagagtggataattccagtgtgctctggggtgtaggggctgtccttagttgtctggctgctggtgctggggtgatcaatacaggtggaagggctgggcacagtggctcacacctgtaatcccagcactttgggaggctgaggcgggtggatcaccagaggtcaggagttcgagaccggcctggccaacatggtgaaaccctgtctctactaaaaatacaaaaattagccgggcatggtggtgtgtgcctgtaatcccagctactccagaggctgaggtaggagaattgcatgaacccgggaggtggggattgcagtgagccgagatcaggccactgcactccagccttggacacacagcaagactctgtctcagacaaaaaaaaaaaaacagatggaaggcagccctaagtgtgatggaccaatataggaggctgctggggagtgggctctggactggttagtttgcatatgaaagtcaggctcctaggaattagctctggactggttggtttgcatataaaagtcaggcctctaggaattagctaatcctaggagagactatacctctgggatccacaagacactaaaatatcaaagcatcagaaaataaaagcgtggttaatacaatctgagaagtcagggctgtcccaggtgacctgctgggcttggggtaaagtcagctgtagccaagatgagtcactggaagtatggttaacgctcttaatttccacaggctccttcaatctacccttttccaggttcttagatcgattacatgcatttattccacagcccatttctttcactgcccaagttgctgggagtccagcaggttcagcctgcagctgagagctttcctggctatcgagcgtactttctacaagtgtttccatctaggatttgaaaacattcaaatgggacagagcctccttccagcttgagttgaaaatagtcatgaaatagctgctatttgggacattcagataaaataaaacaagaaaaaaaagataaactaattaatggtttgaattgttttgggcatttttttttttcatttttgagacagtgtttcttgtctcctaggctggaatgcagtggtgcaatcatagctcactgtggccttgacctcctaggctccagcgatcctcccaccccaacctccctagtagctaggaccacaggtgcataccaccatgcccagctaatttaaaaataaaaaacattttagtagagatggggtcttgctgtgttgcctaggctggtctcaaactcctgggctccaagcagtccttccacctcggcctcccaaagccctgagattacagacacgagtccctatgtctggcttttttgagcatttcttaaatgcccaagtgaggaaaggaccaaatcagttttccagaaccactcgtgaatgactggatatgggggcttgcacaaagccggggccctgcattgccgagagcttttagccctgaatacttttctttgtattatgagatgtcactgtaggtttacagtctttggaagggcccaagaaagatttccccaaagatcttatttaaaaaaaaaagaaaatcaggatttttaaaataaatggcataataatacagctcactacccctctgtagtggctgttcacttcctgcatgaattaggggtgggtactaggagaaagaaaatgaactaccttgagcaaagttgactcttcacagaccccaggtgacacatggaaaataaacatgagtgaagagtcattgcttttcatggtacttagaatccttaacacatttttgtgaacagaggcaggtgtgaaaagaggttttgtttagaaatgcgactggttccttgccggccagcatcaacttcagcttgagaatgaaggcagccacttcagctgtgggccacacttcccaggcctggcagcctctgcagaaaccagactcttctattttttttttttttttttttttttttttttggagacagagtcttgctctgtcacccaggctggagtgcagagtgcagtggggtgatcttggctcactgcaacatctgcctcttggttcaagtgattcttctgcctcagcctcccaagtagccgagactacaggcacacgccatcaccccctgctaatttttgtatttttagtagagacagggtttcaccatgttggccaggctggtctcgaactcctgacctcaggtgattcacccgcctcagcctcctaaagctgggattgtaggcgtgagccactgcgcccagccccttacagccctcttctgttcttggggaggaagatctaggtgtgtttttccctactccaaactttgcaaaattaatgattaaatgaaagagaaattggcttccctgtgaagtcagagccctgttctcatgttttttcccatagtgagatcactaaatctctctactgacagccagggtgcagacgagcaggtagaagtgttgtcagggcctgttggcaggtctgtgaggttggcccccgcgtggctatgctgcatgccgggaagggcttcctcaaagaaaggcaagtgtgctgagacctgctgaaaaggcagctagggcttcacgctgtagaaacaaaagtgcaaggcctgacgcaaccaatgatttgtcactttaccgaggagcctatcagaaatcggctgacatcatcacagctaaaatactccaccagctgtgtttgccacaagtgacaggttcagagtcagtggagactcagacagagagcatgagagggggagatgggagggagagagagaactcatatctggacttaattgaggttccaaaggctacatccttctcccctctgcagtgccttcctgaggggttttctcccctagcctgaagaatcttcctggtcttctcaactggttaggcactgctgacactgcacccacagagaaattcagaaatgtgcaaattgttgagcttaataagcaaaatcacaaatttgattggggaagttgtggaagaagagatggttttctccaaaacagatggcattgtgactctaggcagaaatcctgcatgaacagactcttgaggatgcctgaactcataagacccccccaacatcacacccccagggaaagcagtgtgatatagtatggtggtgacagacccaggggtgcggatttgggtctctggcaggacaagttacttcacctctctgagctgcagcactctcctctctaaaccaggcaaatgagttttgtttttctgtgggtttttgtgttcgtttgtttgcttgttttgagacagggtcttgccctgtcacccaggctgaagtgcagtgatgggatcattggctcactgcagcctcaacctcctggactcaattgatcctcccacctcagcctccccagtagctgggactatgggtgtgtaccactacacccagctaattttctgtgtttttttgtagagacagggttttgctatcttgcccgtgctggtctggaactcctgggctcaagcgatccacccacctcggtctcccaaaatgctgggattataggcgtgagccacggcgcccggccacgtatgattcttcataggagataatctcttgagagggttccgttttttaatgcttcacttttatactttccagaacagcacagcccttgtaaaaatttattagcgtcggttaacaaaaaaccaagaagagcattaagatgaacatgtactgacctcatgctaagcggcacacagacctcatgggaactaaagccatggcatataaaactgaggggtgtttagtttggggatgatttttaaggggctgaattcctcattaagactgtggaaagatgcccccagcattgtcccagctgacgctccagacgaggcaatgtaggagaaaaatgcttttccgtgtttgtcactatccctgtggcattgccctgcccagtacagcttttctccactcgagcaaagcgtctatgcatcccccaggcccccacctaggtgctgtgggaggaaaggggaatgccaggtgttgtccattgttactgcgtgcaccaaaggaagcctccttcctcttcagtggagggtgatagcacgttccccaccctggaagagagttgctgctttgccatgccttgattctggttgagagtcccaaaggatgacagaatcacttcccttgggcctcactgccaaatataatccacttaatatcctccaagtttgaggccataagtctgtggcgcatccagatgcgacccccgaggcgatagcatcaacgtgggagccaatgcaactcaaaagaaggatggggcttcgcacctcctccttgggtaggaagtaggttagctgcttggaaaatgcaggaactggcactgaagagatctgagtctgaacatatccctcacccgtcagtagcactgggaccttgtgcaatgttagttttcccttccctgcttcaacttagatggctcgggccctgagaaagtgattcacagctgaaaaataaatcaaaggcctcgtgttctaaaaagagtttatggaaggagaggcagctgatgaaagtctagaaagaaggctgaacttttccaatgagcacaataagccatttttaccctgcctgtaatcctcggggtggaatcccgcgagtggccgaggcgagcacccttcccgccgttcctgtttctaaggctaaatgatgtcatgccagcctgcgtgagcatatcaatctgtatttctgagtatgaactggatttgaggggtgcattggtgctccagccctccagatcagtaagacaaccaatgcagaaacaagggctcccaggctcctcttctgcaagaggctgttagtgacgtgcccgctgggacagccctgcccaggatggccccagctggggagcctttggcttccatctggcggcgttctatattatcccatccttctgtctcacccttcctaggttcagcttctctgaagagtacacagcatttgctcagtggagttgtaaaatgtattggtaaagtgctctgggttgacacgttcctttgcttctttcctaaatgccaggctctgtgttattagggccgtctgtcgcttcccagcgcctcccgaggtgactgcttccctgactcggtggctgcttaatattcagtgccatttcctcctcccgactgtcctggcgtgggtgtgagtgtgcctgtgtgtgtgctcgtacagcagttgttatcatgatgtacttactggctgtctaccgatggctttcctttcattctactattttttggttgacttctgtgagctgtgagtcatcggtggtaacattatgcattgaatggattagctggtacctaaaaatagccgaggccctcatgcaggcggcacatgagcctgtagagtcagtccctttgcagccaaggcagacccacttgccaacattgaacatgccgagcttggtggcgatgaatcctaatgtatcaaaaaatagatagttggtgactgccctgtgtgcagagcccagccctggatttgtgccgcagttgttggtaatacacacttcctgtctgttctggtgctggaaaggctccaacagagaaactatgtcaaaccacatttttgtttgtgggtctttgtacctctctaaaaaaaaaaaaaaaggagaaaaatgctctcctttaaactgtatgtgctatatgtgcccccaactgggtcatcttatatgttttgattctctcagactgttgttgtttatagcatttagaaaaaaattaaagactattgtttaaagcagttttaggtgtacagcaagtagagagaggtctcacacacctaacagttttccctgttattaaaatcttgcattggtgtgatagattggttacaactgatgagccagtaccgataccttatttttaactaaagtccatagtttatactacagttcactctgtgttgtacatgctgtttttgatgaatttatgatgtcatgtatccagcattacattattatacagaacagctgtaccaccctaaaaatcccttatgcatcaactatttgtcccccacaccccacctgaaactcctggcacccactgatcattttactctctccatagttttgcctgttccagaatgccatgcagttggaatcatccggtatgtcgccttttcacattggcgtctctcacttagcgatatgcatttcaggttcttccatgtcttcttgttgctctgatagctcatttctttttagcactgaatattatgttgttctttaaggcacattttttttttttgagatagggtcttgctctgttgcccaggctggagtgcagtgacaccataatagctcactgcagctttgacctcctaggctcaagcaatcctcccacttcagcctccctaggaacagggaccacaagtacacaccaccacgcccagctaatttttctatttttttgtagagacggggtcttgccatgttgcccaggctgctcttgaactcctgagctcatgtgatcctcccgcctcaggcccccaaagtgctgggattacagggatgagccacccttccctgcctaaggcacacattttaaggccccagaaaaggaaggcaagtgagctagaacctgtgtgcctaagggcttccgtgtcacagctgctgtggtcactcactgggcagtgtccttcctggccatccctgagcctccccacagggccttcccacaagggagctctgtgagccacgctaccatgtgtaagaaaaacccagcttttaatgtgggatttgtgttaggaggcgtcccggtgctagggtgtgggtttactgaacaaccctgaaacacttccaccaaggactgagtcaggctttgcgtgaacatgattcagtgttttaaatagaacactcacagagattcttacactcagccaaagcgttttgactgtttttattaatgatttttaaacattgcagtaaatgggtctctcgcttacccccttcatctttgagacggggttttctgatttttttcatgctgagaacgtaaccatgcagacttagccttccaggaaagcagaccggcctttctctacaggtaaaacaagactgagaatttcacttgcagacaaagttaagaatgcccaatttaataatttcgccaaaaaacaagacatacttactgaaacctagcttatgagagaattcattgctcccagcaacaggcgaaatttgtatgtctgggatagtgtcatgaaaaaatgttttgtaaaacagatgcccttcgcaatttgtgaaaacagggactcttgtgaaggaaatgggagacatatttaaacaacagacgttttgttttctttctatcttgtttttggtgatatgtacatatgtgtgtatatagacatagcaccaatctaagattgaaatatacaatcaaacagcataaatatgcgtgtatgtgcatagtgtttagatatagtagttattgactaagtggtgaaaggaattttattgaattttcatacagaggagctaaaatttttcttaaaagccagtcattagtcagattaggaaggtgacatttaaaaaataattatgagcccagaagtgagtcggtgttgtctccctgtctaggttcgtccatccaaaatgggagttggaggtgacagttctagaggagtcgatttagggggatggatggaggaaggggtaggcagatctcttataaccacactgatgagcacatgggcttgctggcagcagtgggaggagggagggaaagagtggaggagggtgggaggcggtccacccccaaaagcaagaggtgctggcgacagggcatccagagatgaaagacagagggccctcaagcttacaaaagtataaaggccatccctgggcgcggtggctcacacctgtaatcccagcactttgggaggccgaggtgggtggatcatctgaggtcaagagttcaagaccagcctgactaacatggtgaaaacccgtctctactaaatacaaaaaaattagcctggtgtggtggcaggcgcctataatcccagctacttgggaggctgaggcaggagaattgcttgaacctgggaggcagaggttaccgtgaatcaagatggcaccactacactctagccttggcgacagagtgagactctgtctcaaaaaaaaagaaagaaagaaagaaagaaaagttataaaggctattctacttactgcttagggtgtttgaaacaggatatatttactggatgaaaaaatgggctatattgagctgtctggcgttatgtaacgtgctttggttatctgtggtactgctcccatgagtttattttcattgggatttaatcagaaaccattctggaaaatgtgtggaaccccagcaagatcataaaatgacttaatgattactaacacagctgcaagaacgagagtggagagaaaataactgaagtgtgattcaataaaatcatgacgacctcagcatctgacaaggtgaggtggctatggctccgctgagaaagctgcctgttaggcggtaaagccacaccctggagaaagcactgctcctctccctgggggaggtcacagcccactttagttctggctggttaaaaaaaaaaaaaaaaaaaaaaaaaaagacaggcagtctctctattgccccctgttgtccacttgtaccattgcaatgtttttccatacagaaggcaaacagaactattctttcagttttttttttgttttgtttttgttttttttaagacggagtcttgcactgtcacctgggctggggtgcaatggcgtgatcttggctcactgcaacctccgcctcccaggttcaagcaattctcctgcttcagccttcagagtagctgagattacaggcacctgctcccacgcctggctaatttttttgtatttttagtagagacagggtttcaccatgttggtcaggctggtcttgaactcctgacctcatgatcagcccgcctctgcctcccaaagtggtgggattacaggtgtgagccaccatgcccggcctcttctttcagattttaactgagcacctattacttgctaggaagtcttttagactctggagatagaacactgagtttggggaaagaggcaaaacagacaaatatacaagtaaataaaaaagaatgcataagaagataaccagtcccttttggcaccagggactggtttcatggaagaagattttttggcaggatgggaagagggagggggatggttttgggatgaaactgttccacctcagatcatcaggcattagttagattctcataaggagtgcacaacctggattccttgcatgcgcagtttacaatagggttcacgctcctatgagaatctaatgcttgcgactgatctgacaggaggcggagctcagtctggaatggttgctcacctccagctgtgcagcccagtacctaacaggccatggactgctactggtctgttgcctgggggttggggatccctggtataaagaggagaaggggccaggctaggtggctcatgcttgtaatctcagcactttgggaggctgaggcaagagggcacttgaggccaggagttttgaaaccagccaggccaacatagcaaggctccatctctacataatgatcatcattatcttcaccaacaaaacattagctggacatggtggtgcatgcatgtggtcccaactactcaggcggctgaggcaggaagatatcttgagcccacgaggtcaaggctgcagtgagccatgatcatgctactgtactccagcctgggcaacagaacaagaccctatctcaaaataaaaaaaggaagctatggaaactagagggttgttattttaaatagaactgtcaggggagttctctctgaaaaggacagtgggtggcaacagtacgtgaggcaaaaaagattccaaatgaatggagagagtagcaggtgcccagacggaaggcgcaagaggggttaaagaaccagcaaggagaccactgttgctacagtgtagggagtaaggggcacatgcagaccacatcaggcttgcatgtggtgaccgagcgagtgagatgcagcttggccaggacaaaggtggtggaggtagtaaaaaaatagtatcattctaggtgtatttggaaaaggaacccatacagtttgcttataattgggatgtttgtgatgtaagagaaagagcggaagaaagtatgattccaaggtgcttgattgaacagccggaagaatgggataccatttatggagatggggaagaacatgggatggccaccgggcaggggcacatcgggaggtctggtgtgttttaggtcactttaagtttgagttgcccattcgacatctgagtggacgtcatcggatagtgtggtcactggtgtccaaatgtacccgttttgcgtgtatgttctgtctcctggtgggaggcaagaaactaggtcttaaccaatagatactcttctaaggttcctaacacttagcaggtgctcggtgtatacttgttgaacttttattaaaactggaaagcctgaaatgtatcattaggaaccctcaataatattttgaggccgggcacggtggctcacacctgtaatcccagcactttaggaggccaaggcaggcagatcacttgaggtcaggagttcaagaccagcctggccaacatggtaaaaccccgtctctactaaacatacaaaaattagccaggtgtggtggcttatgcctcccagctactcgggaggctgaggcaggagaatcgcttgaacccaggaggtggagtttgcagtgagccgagatagtgccactacattccagcctgggcaacagagcaagactccatctcaaaaaaaaaaataataataataacaatattttgaagctatcagcatcatagagaatacccatatgggttttaaattcaaggaattcacagacttattgttccagttgaagatgacatcatcctacaaaatcacaccgtctctgtttcacatccaaaccagtccccgctggcattgacagcatgttttgagatggagaaggctcctctccaagggaatttcaagcaacagatttgatgatatatattctcactgagaaacccctcagtgagatttcttcattaacggttaatgatcagttaacctttaagaatgtttatatccttatgacaaacctaattataaaataaagatagatttgctatgaatgcttgagtgtacctatttgagatgtgtgcaacaagattttaactttcaccaaagaagggaaaaaaaccttattttacttctcatacattcagaccccaagggggaaaaagtacattgtctaggtagttcacactaattagtgaggagaaaactagcattgggctggcaagctatccgatctgtgcctacaatgatcagattatctgaataatcttccgctcccacctcagctttcatggacccagctgatatctggtcgtggcatcttttcgcagggtgacacagctcctttggtaggaagcaaaggcagaatttaggcaaaaagaaacaaagagaagcctttgaagtgattaaagaagaatctcccaagcctatctaggttaacataaatttcattaacaggccaggtgggcgcggtgactcacttctgtaatcctagcattttgggaggctgtggcgggcagatcgcctgagatcaggagttcaagactagcttggccaacatggtgaatgaaaccccgtgtctactaaaaatataaaaaattagccaggggtggtggtgggcacctgtaatccctgctacttgggaggctgaggcaggagaatcgctcgaatccaggaggcagagattgcagtgagctgagatggtgccactgcactccaacctgggtgacagagcgagactctgtctcaaaaaaaaaaaaaaaattccattaacgtcatcttgttttagtacgcatctcaaatattctctctctccatcacttttctctcgtgaatttttcggcaggctgttctagctatggttcacaccacagcatttaattctaaggcctgtctttggagatttggagtttggtttggtttggtttggtttttagagacagagtcttgctctggcacacaggctggagtggtgcagtagctcgagtgaccctcgcacctctgtaactgaacttaggtttggctgctcaccactcaaaagccaaatacgagagatgaggttggtgagaggaaaagcaggtttattgggaaagccagagaaattgagaagatgatgagctagccttctaaagtaccatctccaggccaggcatggtagctcacatctgtaatcccagcactttgggatgccaaggcaggcggatcacctaaggtcaggagtttgagaccagcctgacccacaatggccaaacaccatctctactaaaaaatacaaaaattagccaggtgtggtggcacatgcctgtagtcccagctactcaggaggctgagacaggagaatagcttgaacctaggaagcagaggttgcagtgagccgagattgtaccactgcactccagcctgggcaacagagaatccatctcaagaaataataattttgtaaaaattaagtaaaatctccaattttttaggctggttggagggtttttatgggaggggggtatggggggagacgaaggggttagtatcgaggagactgaggaccatagacatttgggcaccagtgagggttcaagaaggttgagaacttctttgtccttggtcaggtcataatgctccttcagtctttagtatttttaatagagggtttcaccatattggccagactggtctctaactcctgacctcaggtgatccgcccgcctcggcctcccaaagtgctgggattacaggcgtgagccaccgtgcccagccactcctatcagtctttaacaatatatagttagttgtttatatacttcccctttaatcccagagttagtttctaaaagtacatgattgttgtttgtgtatattatctcggtgccataaaattatcctagcctacgtgcaggaaagggtaaaaccctttaaacaaaaatggagttagttatgttcgttcttttgctatttcacaattgtacctcagcctcccaaagtgctgggattacaagagtggtgtctttggagttttgagatgcggaaataatgaaaggctttcaaaatgtccaataacattatgaagtctttagagggaaacacgtgtatctgtatcctgacttttgcactaatcaattatagtacctgttataaagggcttgtagacatttcttaatgagtctacagatacttggtaacgtggaaatcctcagataagtttacctatgagaacacagtagatgttattttcagaaaattaaatattgcctgccctgtgaagtgtgtataatgtggctcacacaccaagggcctctccatgggtaggtgtccggccatctgccagcaaggagacagggagttatccgggaacacgcagaaccagaaaagaggctgacatgtttggaactaaggcttctggtcttctgaatgtcacattacctctgcctggtgttgggcaagaataagcaaaccgcaactctggtagagagtcttacgagacagatgttaacacctgagagttttatttttatgacttggatttgcagcaaaacaatctccacttgatgtgggattggtttccttctgttcagtttatgttgttaatgactctaagaggtttgcaagaggatctatggagccagttccagattggtcctcctacttagaatacagtgggtatccccatctgatacagtcacttgtaagtatatttgtctatgtatatatgcacatatatgtttctgtgtgtgatgtaaatgtagttttgaaaccaaatagtgtcacacacttgtacagggtaactagaattgtatgagtggctataaggcaaacactgcatcacaattatctgtaccatggaacaagcccatgagctcatgcctttggatcctacttatttcagtcaatattcaccactgttggggggtagcaggaatgcttagttcatctcttttggtggcattgtaatgtctttgctcacaagggtagaggtcaggaggcacagaaaaaagaaaatgggtttgggggccaatgactgggataaaatcctaaacccattagctaatagctatgacattaggcaagtgacttaatctctctgtgactattcgtaaaatttacaaaattggaagagcaatactattccatactaatactattatgaacattaaacaaaatactttttgtaaagtttgtacctgagagcttgacagagagtaggcactcaaaaacttttagcttgcttcacattataaaaatagcccagaacaatgaaactttcccccagtaatacacacaggagaaggggttcatgcttacaagctgccatatgaatgtactcaagttgtctcttctaaaaatatgccttgtatggatccagtaaagtctgtcattctagaaatgtatcagaactagatcaatcagagttaacaaaggaaacaaagaagatgaagtagaaaagcaacaatctgtggaaatctactacttttaaagtttttttggtacttcaattatgcatgtgtgtttttgtgtgtctgaatgtgtataaaatccaatggaggcctgacacggtggctcacgcctgtaatcccagcactttgggagactgaggcgggtggatcatgaggtcaggatatcgagaccatcctggccaacatggtgaagcccccactctactaaaaatacaaaaagtagctgggcgtggtggtggtggtgcatacctgtagtcccagctacttgggagtctgaggcaggagactcgcttgaacccgggaggcggagattgcagtgagccgagatcgcgccactgcactccagcctgggcgacagagcaagactccctctcacaaaaagaaaaaaagaatccaacaatattttaaatattgttacatatagccaatattcattcagattcaccatgtatctaccattttcattcctcttcattcctccctgtacaaacttcaatctagatttgttttttctctacctaaagaataccttttagtattttctataatgcagatctgttgatggtgaattcttttaattactgtttgtctgaacatgtctctattttgccttcattctggaaggatctttttgctccatatagaattcgccattgacaattctttttctttagcactgtaaagatattccattgtctccattgtctactggcttccattatttttgttgagatgtaaactgtgagttccattgttgcttatttggagataatatgtattttgttctagaggctttttttttttaatggagtttctctattgtcgcccagtctagagtgtgatggaatgatcttggctcactgcaacgatcttggctcactgcaacgatcttggctcactgcaacctccgcctcccgggttcaagtgattctcctgcctcagccccccgagtagctgggattacaggttcctgccaccatgcccagctaatttttgcatttttagtagagatggggtttcaccatgttggccagactggtctcaaactcctgacctcaggtaatccacccacctcggcctcccaaagtgctgggattacaggcaggagccaccacacccagcctgttctagaggcttttaacgatattttttcctgtttagtttacaagatgtctttgatttatagcagtttaattctcatctgcctcagtgaggatttctttttgtttatttttcctgtttggggctaggccttcttgaaactgtcttattatccttcttcagtttgggaaaattcttagccattacctcctcaagtattaacttctgccctattatctccctctcttcctcctcctaggattcaaattatgtgtctgttagcccctctcaatgtatcctatgtgtctcttaccctctcctccatattgaccatctttttgtctctatgttcactctgtggagtctcttctaaagctctaattagagaatccagttcctgaattctttcttaatccatgtctattcaactggaaagctcattgcattcttgatttcagtggtgtatattttaattctacaattctcatagaccttttttaattaattaattattattattattattatttattttttttttttttagagacagagtctcactctgttgtccaggctggagtgcagtcttgtgatcatagctcactgcaacctctaactcctgggctcaagatcctcctgcctcagcctcctgagtagttgggactacaggcacgcatcaccacactaggctatttttttttaaatttctgtagaaacggggtctcattttgttgcccagactggtctgaaactcctggcctcaagtgatcctccctgtctcagcctcccaaagtactgagattacaggcatgagccaccatgcctggcttcatggatcttttaaaaacagattctagtttcctatcaaaattctcaagctgtctttaatcttcttaattattgtaagcatagtctttgtaaagtctatatgtatgactctatatgagaagccctggtgcatccttttttaagatctgatattttgctagtgcttatacaagctatctggtctcctcatgaccaccaccccccttttttaaattgaatgcttttatttgcaaaattgtgaaagtaattcaagaccttaatccagttttagggactcagatgagtcaatctgagcttcagaccttgaaaggcctgttggcttgtggttcactgtctcctctaagggacagtgctttggggtcacaactcaaaagaatggggctcaccagagaacaccctcccttggtgtatcctgaactccattacctgttccctatgctcttaacactatcaaaagcccacttggtttcccaactgctccactttggaatgttcaagtgccttcaggagaaaacaggcccccaacaccagcttcacctctctgggccatcatcttttcctgatccaacccaggaagtgtgtgtgtgtgtgtgtgtgtgtgtgtgtgtgtgtgtgtgtgtgtgacggagtttcactctgtcgcccaggctggagtgaagtggcatgatctcggttcactgcagcctccgcctcccgggttcaagcgattctcttgcctcagcctcctgagtagctgggattataggcgcctgccaccacacctggctaatttttgtatttttagtagggacagggtttcaccatgctggccaggctggtctcagagtaaagtggcacgatcttggctcactgcaaccttcgtcccccggactcaaacgattctcctgcctcagcctcctgagtagctgggattataggggcccaccaccacacctggctaagttttgtatttttagtagagatggggttttgccatggtagccaggctggtctcaaactcctgacctcaggtgatccacgcgccttggcctcccaaagtgctgggattacaggcatgagccaccgcgcctggcctttttactatcttatttgctgtccagtactataagaaaaaaagtttaaacattttgtccagagtttttaaatttatttgtttgcttatatttttgttcagagtttttagttgtcctcagaaggagggttggtccaaattacctagtctactacatctagaaaggacattggaaattgactttttttttttttttttgagacggagtctcactctgtggcccaggctggatcgcccagtggcacgatctcggctcgctgcaacatctgcctcctgggttcaagtgattctagtgtttcagcctcccaagtagctgggattacaggtgcccgccaccacgcatggctaattttttttttttatttttagtggagacggggtttccccatgttggccaggctggtcttgaactcctgacctcaaatgatccacccaccttggtgtcccaaagtgctgggattacaggcatgagccactgtgcccagccaccaagcatccttttaggggctggggactcagtgataaacacactgtgcctgcttcttggaactcacagtctcactctgatccatgtttagtcctgtcctgtatgataatagcagttgtccattgagctcataaaatctaagaccgcgctgggcttgtgagccacctgcagagcctagcttggtgctgaaagctaagtgggtgctctgtcattactggggttcgattgactggttctaacagagaccagctatagagctaacacttgatggaatattttgaatattgatgaccttttcactggcttctgcctatggcaagtagaggtacaacccaaagagaagagcctcatttatagtgtgtggctgggggagagggaggtttgcaaactgagtcattttcccccattcagcctgtgtgtgtctgtgtgagttcatacctgtgtgtgtgcataaaatcaaacaagaataaaatgttttcatttgttcccttccttcttcctctctctgtctctccctgtttccacaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgcagatgtgtgtctttgccttctgttgggtcctcaaggaagaggccaggaaaagagtgctaattcctcctccttattgacccccgctcacgagttctccctgggtaggtcggaggtagggaggtgtgacatgaggcattgccttcgctgctaatgttttggggggaagagtacgtgtgagatgaggttctaagataaaaggcacacagccacacctgatgtcttggtttcttcagttcatgtttatgcctcctagctgaacactgctgttcacaagaggtatacttgtctttaaacatgtggtagcttcatgcgctcgtgtggcataatctatacactccttacagatttgctctaaactggttagtggtctgtaagtggaaaatttatttttacttcctgtaattcaagctcattagaaattcagcgagcagaccgggcacagtggctcacgcccataatcccaacagttggggaggccgaggcacaaggcctgcttgagcccaggagttcgagaccagcctagtcaacatagtaagacctcatctctacaaaaaatgaaattagccgggtgtggtggcacatacctatggtcccagctacttaggggactgaggtgggaggatcgcctggggccaggaggtcgaggctgcagtgagccataatcataccgctgcactccagcctgggcgacagagcaaaactctgcctcaaaaacaaaaaaaaaacccaactcctcgagcaggtctctcagcatgtggaggaactccccgtttacctcaagagtaccacattacagctttgcactgggcccagtcttggaaagatatggcttagcagttgtgccagaaaaagtaattcctcaagaacccatagcttccaggtggaatcccctgcacccacctcaacccacctcaacccacctcaagaccttccagcctcaaggttacacagaggtgggagaacgcttggggttaaattcattttcacttagccaaggaggaactatcttcttgggaaggtgttttggactctcctctgattatttagttgaggtcctgacacattatataataaatatgtgaaaggacacacagcaaaccagagctgtgtaggtgcaactcaggctacaagggctgccccaggtcctgtggagtagcccgggcaaatgtgcctgtgtgctgtgggcaaactcggcaaagcagtctgcatctctgccttccctttttgtttgtgtgagatactgattgttctgacaagtttggggtccagtggctgtgttacttacctcagctggtgaaatcaattagggggaaccataccttcaggtgctgcagcggggcaggacttgaaaccatcaaaagcactgccagagccctcagatggaacggccagagtggcccaaggcaaatggcgtcgagttcactggctgtcctcctcctcccccagctctggcacaggaagcccagtgggtcagcagcaaagctgcatgcttcatctccaggtcctgtgggacacccggtccaagggacactctggtgtgggctcccccagccccactcctatcagaggcagagatgaacctgctaaggcaaacggtgacggagccttacaagttctctttatgggccaggcgcggtggctcacacctgtaatcccagcactttgggaggctgaggtgggtggatcacccgagcccaggagtttgagaccagcctgggtaacatggcaaaaacccatctctactaaaaacataaacattagccagacgtggcgggcacctgtaatcccggctactctgaaggctgaggcacgagaatcacttgaacctgggaggcggaggttgcagtgagccgagattgtgccactgcactctgcctgggtgacagagcaagacttggtctcaggaaaaaaaaaaaaaaaaaagacattctctttctgaaggctctgcttcaaaatggtcctaacgagtttttgattttgtaactactcagttacaagcagctggaagaccacagagagcaaggcggggagcctgcagccaagccccatgtcttgctccacgttaaatcgcctcttggccctcccgtctccaaagtgcagcccttgtgtttctacaggtgcaagagttattcttaatgggccgggcacagtggctcacacctgtaatcctagcactttggggaggttgacgcaggtggatggcttgagccctggagtttgagaccagtctgggcaacatggtgagaccctgtctctataaaaaatacaaaaattagctgggcgtggtagcaggtgtctgtagtcccagctacttgggagactgaggtcagaggatcacctgagcccgggaggtcaaggctgtggtgagctgtgatcctgccactgcactccagcctgggcaacagagaccctgtctcaaattaaaaaaaaaaaaaaaaaaaaaaaaaaaaaactcttaatggatttagtaggggaaagtattacaatggagacaatgctgctggctggatctctaaacataatcttaaaggaccaacagtgggcctgtattatcccagagtgtgacagctctggttggacccttctcatgccatcggtcactgtggacaatcaggccattcattcaccctggcacagcagcaccctgtggatcttctctactccagggtcattgcttgcctttccaaagaaaactgacttgtgtatctgctcttcagccttattaaaaagcaaagtaaaacaacctgatctgcatacgctttccaggcctggaactcaatacttcaaagtttagcggccggtcatcacttcttctgcgttcactgtttaaacaagcatcctggtggactgctgcaggtcagctgcagaggccaattctccaagacaatgtcattgttcccaacccgttaactgacccttatacagtagtgccatgtggtccttccgagaaaggattcactggcacactgagggaatggctctaactcatgtctcaaaccaatgccttttaggatgccactgatcaaagctttggctctttttcagtgtgactccacctgctaatttcttgggagacaaccttcccataaaacatcctgtggaatttcaaatt

SEQ ID NO: 3 - DNA, 10587 bp, Homo sapiens
  source 1..10587: mol_type = genomic DNA
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcagcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 4 - DNA, 1676 bp, Homo sapiens
  source 1..1676: mol_type = genomic DNA
ggggaggagagagcagagtataccgcagacatcatttctactacagtggcggagccgtacaggacctgtttcactgcagggggatccaaaacaagccccgtggagcagcagccagagcaacagcagccgcaagacattgtttctctccttctgcccccccttccccacgcaaccccagatccatttacactttacagtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggtttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggacttgcaaaaaaaaaaaaaaaaaaaaaaaaaaaaaa

SEQ ID NO: 5 - DNA, 924 bp, Homo sapiens
  source 1..924: mol_type = genomic DNA
gaggaggagggatcacttgagttgagctctgctgactagattgcatttctgtgggaagagatggatggagcatgaggaaggccatgtgtgtgtctgggacataacaagccaatgcacgcatactggagcatagtgaaagagtctattttgaagcttcaaacttagtgctgctgcagaccaggaacaagagagaaagagtggatttcagcctgcacggatggtcttgaaacacaaatggtttttggtctaggcgttttacactgagattctccactgccaccctttctactcaagcaaaatcttcgtgaaaagatctgctgcaaggaactgatagcttatggttctccattgtgatgaaagcacatggtacagttttccaaagaaattagaccattttcttcgtgagaaagaaatcgacgtgctgttttcatagggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttatctgatgcacaaaggaaaataataatacaaaacccataacctattcattgtattgttgcggtagatcgagctacatgctgcacagcaaaagaccttctttgcacttctttcaagcagaattattgctgtatattcactctgaactgagagatcattgcaaaaaaaaaaaagaagaagaagaagagaagaaaagaaaaaagaaataggttaagcaaattttgtggtggtgcttatgtgtgcacagacatgcatgaggcctccgcatcttccaaacttggaaagcatattttaacagcacaaatatatctacatgtttgatccaaaaaaaaaaaaaaaaaaaaaaaaaaaaaa

SEQ ID NO: 6 - DNA, 3375 bp, Homo sapiens
  source 1..3375: mol_type = genomic DNA
gtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagagcatcgtgcatcaagtcaccagggtggtccattcaagctgcagatttgtttgtcatccttgtacagcaatctcctcctccactgccactacagggaagtgcatcacatgtcaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttgttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaacctgttcattgtttataccttgaccatcttttctgtcttattgctgaaccatcgcttctctttctacttctcttctgggatttcatcttgctcagctaaaattctagtgtgttattctgaatattatggctggagtttcctgaccaacttcttgcatctgagtccatttcctgtgcttaaggctgctggcattccattcactgctcctagtcaaaactgaaacttctcctgctaatgagattaggccttacaacactattaatttcttcctctctatttcttgctccattgttatttctcagagatgaaaatctatttgtcattatgagattcattttggcatcacttactaaagttcccttggatttttctgttcttcatacaccctacagcttcaaactgcaacagtcatcaactggtctttgacaaattagttgtctctacacatggtttacaatattacactagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttgaaaaaaaaaaaaaaa

SEQ ID NO: 7-10 - skipped (4 entries)

SEQ ID NO: 11 - DNA, 22 bp, synthetic construct
  source 1..22: mol_type = other DNA
catccagagtgcagagataagc

SEQ ID NO: 12 - DNA, 22 bp, synthetic construct
  source 1..22: mol_type = other DNA
actctaccaaaacttcaacgct

SEQ ID NO: 13 - DNA, 25 bp, synthetic construct
  source 1..25: mol_type = other DNA
agaggattgaagacagccatagccc

SEQ ID NO: 14 - DNA, 21 bp, synthetic construct
  source 1..21: mol_type = other DNA
gtataggctgaggctacctgt

SEQ ID NO: 15 - DNA, 20 bp, synthetic construct
  source 1..20: mol_type = other DNA
gatccaggctcttcatgagg

SEQ ID NO: 16 - DNA, 26 bp, synthetic construct
  source 1..26: mol_type = other DNA
acagcagctctggatgaacattcact

SEQ ID NO: 17 - DNA, 15 bp, synthetic construct
  source 1..15: mol_type = other DNA
tcgccgcttgctgca

SEQ ID NO: 18 - DNA, 17 bp, synthetic construct
  source 1..17: mol_type = other DNA
atcggccgtgatgtcga

SEQ ID NO: 19 - DNA, 23 bp, synthetic construct
  source 1..23: mol_type = other DNA
ccatggtcaaccccaccgtgttc

SEQ ID NO: 20-22 - skipped (3 entries)

SEQ ID NO: 23 - DNA, 20 bp, synthetic construct
  source 1..20: mol_type = other DNA
ctgcggtatactctgctctc

SEQ ID NO: 24 - DNA, 20 bp, synthetic construct
  source 1..20: mol_type = other DNA
ggaggaggagattgctgtac

SEQ ID NO: 25 - DNA, 20 bp, synthetic construct
  source 1..20: mol_type = other DNA
gtgcaggctgaaatccactc

SEQ ID NO: 26 - DNA, 20 bp, synthetic construct
  source 1..20: mol_type = other DNA
gtgttctttcttcctttcac

SEQ ID NO: 27 - DNA, 20 bp, synthetic construct
  source 1..20: mol_type = other DNA
atttcatttttcgccgtccc

SEQ ID NO: 28 - DNA, 20 bp, synthetic construct
  source 1..20: mol_type = other DNA
ctttgtgtaaacctattccc

SEQ ID NO: 29 - DNA, 20 bp, synthetic construct
  source 1..20: mol_type = other DNA
tcagctttcttggtggcctc

SEQ ID NO: 30 - DNA, 20 bp, synthetic construct
  source 1..20: mol_type = other DNA
gtgtggtctgaatgaccgtg

SEQ ID NO: 31 - DNA, 20 bp, synthetic construct
  source 1..20: mol_type = other DNA
gtcttccaccttctttagct

SEQ ID NO: 32 - DNA, 20 bp, synthetic construct
  source 1..20: mol_type = other DNA
ggctgtcttcaatcctctct

SEQ ID NO: 33 - DNA, 20 bp, synthetic construct
  source 1..20: mol_type = other DNA
tccgttttcctgctcggcat

SEQ ID NO: 34 - DNA, 20 bp, synthetic construct
  source 1..20: mol_type = other DNA
acttgcctacattagaccgg

SEQ ID NO: 35 - DNA, 20 bp, synthetic construct
  source 1..20: mol_type = other DNA
accgctcctgctgtgccctt

SEQ ID NO: 36 - DNA, 20 bp, synthetic construct
  source 1..20: mol_type = other DNA
cgctctctccctctccccca

SEQ ID NO: 37 - DNA, 20 bp, synthetic construct
  source 1..20: mol_type = other DNA
tgtttttgttttttccccaa

SEQ ID NO: 38 - DNA, 20 bp, synthetic construct
  source 1..20: mol_type = other DNA
attgaaactttcaatatctt

SEQ ID NO: 39 - DNA, 20 bp, synthetic construct
  source 1..20: mol_type = other DNA
cccttttctctcagtttctc

SEQ ID NO: 40 - DNA, 20 bp, synthetic construct
  source 1..20: mol_type = other DNA
ttttttttaaagcactttaa

SEQ ID NO: 41 - DNA, 20 bp, synthetic construct
  source 1..20: mol_type = other DNA
gattttttttttaatttgtg

SEQ ID NO: 42 - DNA, 20 bp, synthetic construct
  source 1..20: mol_type = other DNA
tgtgtgtttttctgagtcca

SEQ ID NO: 43 - DNA, 20 bp, synthetic construct
  source 1..20: mol_type = other DNA
gtgttttcccatcttagtgt

SEQ ID NO: 44 - DNA, 20 bp, synthetic construct
  source 1..20: mol_type = other DNA
tgggaggctctctccctcct

SEQ ID NO: 45 - DNA, 20 bp, synthetic construct
  source 1..20: mol_type = other DNA
cggtaaatattgcaaagtgg

SEQ ID NO: 46 - DNA, 20 bp, synthetic construct
  source 1..20: mol_type = other DNA
gtttgttggtttcttattaa

SEQ ID NO: 47 - DNA, 20 bp, synthetic construct
  source 1..20: mol_type = other DNA
ggcatccatctctgtatccc

SEQ ID NO: 48 - DNA, 20 bp, synthetic construct
  source 1..20: mol_type = other DNA
cattggagatttttctctct

SEQ ID NO: 49 - DNA, 20 bp, synthetic construct
  source 1..20: mol_type = other DNA
tctctatttcagaaattctg

SEQ ID NO: 50 - DNA, 20 bp, synthetic construct
  source 1..20: mol_type = other DNA
atctatgtaaaagaaatctc

SEQ ID NO: 51 - DNA, 20 bp, synthetic construct
  source 1..20: mol_type = other DNA
aattttttaaaacattacct

SEQ ID NO: 52 - DNA, 20 bp, synthetic construct
  source 1..20: mol_type = other DNA
ggtatagtttaagagccttt

SEQ ID NO: 53 - DNA, 20 bp, synthetic construct
  source 1..20: mol_type = other DNA
gcctctttatattaaataaa

SEQ ID NO: 54 - DNA, 20 bp, synthetic construct
  source 1..20: mol_type = other DNA
tctgaatttaagaattgtaa

SEQ ID NO: 55 - DNA, 20 bp, synthetic construct
  source 1..20: mol_type = other DNA
acctaatacttggtattctg

SEQ ID NO: 56 - DNA, 20 bp, synthetic construct
  source 1..20: mol_type = other DNA
gtgtctgttttcccttggcc

SEQ ID NO: 57 - DNA, 20 bp, synthetic construct
  source 1..20: mol_type = other DNA
gtatgcacttaaaattttct

SEQ ID NO: 58 - DNA, 20 bp, synthetic construct
  source 1..20: mol_type = other DNA
atagaatatgaattcttcca

SEQ ID NO: 59 - DNA, 20 bp, synthetic construct
  source 1..20: mol_type = other DNA
attggcactgttattttatt

SEQ ID NO: 60 - DNA, 20 bp, synthetic construct
  source 1..20: mol_type = other DNA
ggctctttaaatattactcc

SEQ ID NO: 61 - DNA, 20 bp, synthetic construct
  source 1..20: mol_type = other DNA
gtttgactagatgtgcttct

SEQ ID NO: 62 - DNA, 20 bp, synthetic construct
  source 1..20: mol_type = other DNA
tcttgagcttttaattttac

SEQ ID NO: 63 - DNA, 20 bp, synthetic construct
  source 1..20: mol_type = other DNA
tgctccttttatcattgtca

SEQ ID NO: 64 - DNA, 20 bp, synthetic construct
  source 1..20: mol_type = other DNA
cggtggtttgttgtaccctt

SEQ ID NO: 65 - DNA, 20 bp, synthetic construct
  source 1..20: mol_type = other DNA
tgtactctataattttttaa

SEQ ID NO: 66 - DNA, 20 bp, synthetic construct
  source 1..20: mol_type = other DNA
tgagctgcttttcatattct

SEQ ID NO: 67 - DNA, 20 bp, synthetic construct
  source 1..20: mol_type = other DNA
caatagacaaaaattatcat

SEQ ID NO: 68 - DNA, 20 bp, synthetic construct
  source 1..20: mol_type = other DNA
tttccgaagctgctatatgt

SEQ ID NO: 69 - DNA, 20 bp, synthetic construct
  source 1..20: mol_type = other DNA
gtctctctttttctaagtca

SEQ ID NO: 70 - DNA, 20 bp, synthetic construct
  source 1..20: mol_type = other DNA
agactaatatatatatatat

SEQ ID NO: 71 - DNA, 20 bp, synthetic construct
  source 1..20: mol_type = other DNA
gggtctcttcatctaccttc

SEQ ID NO: 72 - DNA, 20 bp, synthetic construct
  source 1..20: mol_type = other DNA
tgttcctttcttctttgttc

SEQ ID NO: 73 - DNA, 20 bp, synthetic construct
  source 1..20: mol_type = other DNA
gggtgtgtattcaattctct

SEQ ID NO: 74 - DNA, 20 bp, synthetic construct
  source 1..20: mol_type = other DNA
gtgactttaaagctttcctg

SEQ ID NO: 75 - DNA, 20 bp, synthetic construct
  source 1..20: mol_type = other DNA
actgagaggcatctccagtg

SEQ ID NO: 76 - DNA, 20 bp, synthetic construct
  source 1..20: mol_type = other DNA
tgtcaactagttcttatcac

SEQ ID NO: 77 - DNA, 20 bp, synthetic construct
  source 1..20: mol_type = other DNA
ggtaagggccactaaatctg

SEQ ID NO: 78 - DNA, 20 bp, synthetic construct
  source 1..20: mol_type = other DNA
cttaccacagagacatgccc

SEQ ID NO: 79 - DNA, 20 bp, synthetic construct
  source 1..20: mol_type = other DNA
ggagtattataacaatttgc

SEQ ID NO: 80 - DNA, 20 bp, synthetic construct
  source 1..20: mol_type = other DNA
gtctgggctgatgatgctgg

SEQ ID NO: 81 - DNA, 20 bp, synthetic construct
  source 1..20: mol_type = other DNA
gtctgcctttaacatttttc

SEQ ID NO: 82 - DNA, 20 bp, synthetic construct
  source 1..20: mol_type = other DNA
tgttgtttataagtttacgg

SEQ ID NO: 83 - DNA, 20 bp, synthetic construct
  source 1..20: mol_type = other DNA
tgcagcttattttataggtg

SEQ ID NO: 84 - DNA, 20 bp, synthetic construct
  source 1..20: mol_type = other DNA
cggtgtcttaatatcctcag

SEQ ID NO: 85 - DNA, 20 bp, synthetic construct
  source 1..20: mol_type = other DNA
gttcctcatcttaatcacag

SEQ ID NO: 86 - DNA, 20 bp, synthetic construct
  source 1..20: mol_type = other DNA
gtgactcatcttggctacag

SEQ ID NO: 87 - DNA, 20 bp, synthetic construct
  source 1..20: mol_type = other DNA
attttccatgtgtcacctgg

SEQ ID NO: 88 - DNA, 20 bp, synthetic construct
  source 1..20: mol_type = other DNA
gtgcagtgtcagcagtgcct

SEQ ID NO: 89 - DNA, 20 bp, synthetic construct
  source 1..20: mol_type = other DNA
gttgtcttactgatctggag

SEQ ID NO: 90 - DNA, 20 bp, synthetic construct
  source 1..20: mol_type = other DNA
tgagacctctctctacttgc

SEQ ID NO: 91 - DNA, 20 bp, synthetic construct
  source 1..20: mol_type = other DNA
tcagtccttggtggaagtgt

SEQ ID NO: 92 - DNA, 20 bp, synthetic construct
  source 1..20: mol_type = other DNA
tctgttgtttaaatatgtct

SEQ ID NO: 93 - DNA, 20 bp, synthetic construct
  source 1..20: mol_type = other DNA
tctttcatctctggatgccc

SEQ ID NO: 94 - DNA, 20 bp, synthetic construct
  source 1..20: mol_type = other DNA
gtgttctatctccagagtct

SEQ ID NO: 95 - DNA, 20 bp, synthetic construct
  source 1..20: mol_type = other DNA
tggtgaagataatgatgatc

SEQ ID NO: 96 - DNA, 20 bp, synthetic construct
  source 1..20: mol_type = other DNA
tccagttttaataaaagttc

SEQ ID NO: 97 - DNA, 20 bp, synthetic construct
  source 1..20: mol_type = other DNA
attttacttaatttttacaa

SEQ ID NO: 98 - DNA, 20 bp, synthetic construct
  source 1..20: mol_type = other DNA
atgtgcatatatacatagac

SEQ ID NO: 99 - DNA, 20 bp, synthetic construct
  source 1..20: mol_type = other DNA
cttttctacttcatcttctt

SEQ ID NO: 100 - DNA, 20 bp, synthetic construct
  source 1..20: mol_type = other DNA
gtgttctctggtgagcccca

SEQ ID NO: 101 - DNA, 20 bp, synthetic construct
  source 1..20: mol_type = other DNA
tgtagtagaaatgatgtctg

SEQ ID NO: 102 - DNA, 20 bp, synthetic construct
  source 1..20: mol_type = other DNA
aaatagactctttcactatg

SEQ ID NO: 103 - DNA, 20 bp, synthetic construct
  source 1..20: mol_type = other DNA
gtggcagtggagaatctcag

SEQ ID NO: 104 - DNA, 20 bp, synthetic construct
  source 1..20: mol_type = other DNA
tcagcctatacttcaccatg

SEQ ID NO: 105 - DNA, 20 bp, synthetic construct
  source 1..20: mol_type = other DNA
ggttggatttcatttttcgc

SEQ ID NO: 106 - DNA, 20 bp, synthetic construct
  source 1..20: mol_type = other DNA
tccactgtattgggaggacc

SEQ ID NO: 107 - DNA, 20 bp, synthetic construct
  source 1..20: mol_type = other DNA
ctcagctttcttggtggcct

SEQ ID NO: 108 - DNA, 20 bp, synthetic construct
  source 1..20: mol_type = other DNA
cgcttccatgtcagtgctgc

SEQ ID NO: 109 - DNA, 20 bp, synthetic construct
  source 1..20: mol_type = other DNA
tctgtttttaagtcttccac

SEQ ID NO: 110 - DNA, 20 bp, synthetic construct
  source 1..20: mol_type = other DNA
ggcgaactgtatcacggcca

SEQ ID NO: 111 - DNA, 20 bp, synthetic construct
  source 1..20: mol_type = other DNA
tggttgattccgttttcctg

SEQ ID NO: 112 - DNA, 20 bp, synthetic construct
  source 1..20: mol_type = other DNA
cctacagtacagtaatctgg

SEQ ID NO: 113 - DNA, 20 bp, synthetic construct
  source 1..20: mol_type = other DNA
cacgggacttttctcctgac

SEQ ID NO: 114 - DNA, 20 bp, synthetic construct
  source 1..20: mol_type = other DNA
gttcgctctctccctctccc

SEQ ID NO: 115 - DNA, 20 bp, synthetic construct
  source 1..20: mol_type = other DNA
ttgtttttgttttttcccca

SEQ ID NO: 116 - DNA, 20 bp, synthetic construct
  source 1..20: mol_type = other DNA
catttattgtcacatactag

SEQ ID NO: 117 - DNA, 20 bp, synthetic construct
  source 1..20: mol_type = other DNA
ggttctttaaaagttcatct

SEQ ID NO: 118 - DNA, 20 bp, synthetic construct
  source 1..20: mol_type = other DNA
cttttttttaaagcacttta

SEQ ID NO: 119 - DNA, 20 bp, synthetic construct
  source 1..20: mol_type = other DNA
ggttgataccagattttttt

SEQ ID NO: 120 - DNA, 20 bp, synthetic construct
  source 1..20: mol_type = other DNA
gtgtgtgtttttctgagtcc

SEQ ID NO: 121 - DNA, 20 bp, synthetic construct
  source 1..20: mol_type = other DNA
atgtgtgttttcccatctta

SEQ ID NO: 122 - DNA, 20 bp, synthetic construct
  source 1..20: mol_type = other DNA
gtctccttggctggctcttt

SEQ ID NO: 123 - DNA, 20 bp, synthetic construct
  source 1..20: mol_type = other DNA
gtgttccattgtaaacgcaa

SEQ ID NO: 124 - DNA, 20 bp, synthetic construct
  source 1..20: mol_type = other DNA
tcttgtttgttggtttctta

SEQ ID NO: 125 - DNA, 20 bp, synthetic construct
  source 1..20: mol_type = other DNA
tccactttaaaagatctgag

SEQ ID NO: 126 - DNA, 20 bp, synthetic construct
  source 1..20: mol_type = other DNA
gcacggtattagtgtcttca

SEQ ID NO: 127 - DNA, 20 bp, synthetic construct
  source 1..20: mol_type = other DNA
tcttaaattctctatttcag

SEQ ID NO: 128 - DNA, 20 bp, synthetic construct
  source 1..20: mol_type = other DNA
tcttcagcttctcaaatcag

SEQ ID NO: 129 - DNA, 20 bp, synthetic construct
  source 1..20: mol_type = other DNA
tctgcttttttttttttaca

SEQ ID NO: 130 - DNA, 20 bp, synthetic construct
  source 1..20: mol_type = other DNA
aagtactttcagcataggaa

SEQ ID NO: 131 - DNA, 20 bp, synthetic construct
  source 1..20: mol_type = other DNA
cgtatttattctggcctctt

SEQ ID NO: 132 - DNA, 20 bp, synthetic construct
  source 1..20: mol_type = other DNA
aatacagttgaaccatttgt

SEQ ID NO: 133 - DNA, 20 bp, synthetic construct
  source 1..20: mol_type = other DNA
acagcttgagctagtgtcac

SEQ ID NO: 134 - DNA, 20 bp, synthetic construct
  source 1..20: mol_type = other DNA
tggtgtctgttttcccttgg

SEQ ID NO: 135 - DNA, 20 bp, synthetic construct
  source 1..20: mol_type = other DNA
ggaattacagagagtatgca

SEQ ID NO: 136 - DNA, 20 bp, synthetic construct
  source 1..20: mol_type = other DNA
gttttattataataatgaaa

SEQ ID NO: 137 - DNA, 20 bp, synthetic construct
  source 1..20: mol_type = other DNA
gtagtagtttttgtgaggta

SEQ ID NO: 138 - DNA, 20 bp, synthetic construct
  source 1..20: mol_type = other DNA
gtcaccttttctatttgcac

SEQ ID NO: 139 - DNA, 20 bp, synthetic construct
  source 1..20: mol_type = other DNA
attttgacttttgattggtg

SEQ ID NO: 140 - DNA, 20 bp, synthetic construct
  source 1..20: mol_type = other DNA
gggactctgtctttatttcc

SEQ ID NO: 141 - DNA, 20 bp, synthetic construct
  source 1..20: mol_type = other DNA
atgtttctatctaagtccca

SEQ ID NO: 142 - DNA, 20 bp, synthetic construct
  source 1..20: mol_type = other DNA
gtgtgcatttttaattttgt

SEQ ID NO: 143 - DNA, 20 bp, synthetic construct
  source 1..20: mol_type = other DNA
tgaggacatcatgatggtgc

SEQ ID NO: 144 - DNA, 20 bp, synthetic construct
  source 1..20: mol_type = other DNA
gttttgtttcagtattaggt

SEQ ID NO: 145 - DNA, 20 bp, synthetic construct
  source 1..20: mol_type = other DNA
tacatcctgaaaatcacagc

SEQ ID NO: 146 - DNA, 20 bp, synthetic construct
  source 1..20: mol_type = other DNA
ctctcacttttcttctcctt

SEQ ID NO: 147 - DNA, 20 bp, synthetic construct
  source 1..20: mol_type = other DNA
gtctccttacatagtgctgc

SEQ ID NO: 148 - DNA, 20 bp, synthetic construct
  source 1..20: mol_type = other DNA
atatattagactaatatata

SEQ ID NO: 149 - DNA, 20 bp, synthetic construct
  source 1..20: mol_type = other DNA
tcaggtttatatgtatacaa

SEQ ID NO: 150 - DNA, 20 bp, synthetic construct
  source 1..20: mol_type = other DNA
gtttgtttagatttatcctc

SEQ ID NO: 151 - DNA, 20 bp, synthetic construct
  source 1..20: mol_type = other DNA
gtcatagctctcctctgcac

SEQ ID NO: 152 - DNA, 20 bp, synthetic construct
  source 1..20: mol_type = other DNA
gtcagcatacttagcttttc

SEQ ID NO: 153 - DNA, 20 bp, synthetic construct
  source 1..20: mol_type = other DNA
cagggctggactgagaggca

SEQ ID NO: 154 - DNA, 20 bp, synthetic construct
  source 1..20: mol_type = other DNA
tgagactattatagtttcca

SEQ ID NO: 155 - DNA, 20 bp, synthetic construct
  source 1..20: mol_type = other DNA
taaaatgcaccaatcaacgc

SEQ ID NO: 156 - DNA, 20 bp, synthetic construct
  source 1..20: mol_type = other DNA
gttactttatttctctaggg

SEQ ID NO: 157 - DNA, 20 bp, synthetic construct
  source 1..20: mol_type = other DNA
atttgtcttgttgtatgttg

SEQ ID NO: 158 - DNA, 20 bp, synthetic construct
  source 1..20: mol_type = other DNA
gttattttaaatagtggcct

SEQ ID NO: 159 - DNA, 20 bp, synthetic construct
  source 1..20: mol_type = other DNA
tctttggcttttagacctgt

SEQ ID NO: 160 - DNA, 20 bp, synthetic construct
  source 1..20: mol_type = other DNA
atgttatatcaatgttctgt

SEQ ID NO: 161 - DNA, 20 bp, synthetic construct
  source 1..20: mol_type = other DNA
gtctcagctcaagagtctgt

SEQ ID NO: 162 - DNA, 20 bp, synthetic construct
  source 1..20: mol_type = other DNA
tggcctgtatatctatggac

SEQ ID NO: 163 - DNA, 20 bp, synthetic construct
  source 1..20: mol_type = other DNA
tcagccatagctcactacag

SEQ ID NO: 164 - DNA, 20 bp, synthetic construct
  source 1..20: mol_type = other DNA
gtcccatttgaatgttttca

SEQ ID NO: 165 - DNA, 20 bp, synthetic construct
  source 1..20: mol_type = other DNA
tcactcatgtttattttcca

SEQ ID NO: 166 - DNA, 20 bp, synthetic construct
  source 1..20: mol_type = other DNA
tctgaatttctctgtgggtg

SEQ ID NO: 167 - DNA, 20 bp, synthetic construct
  source 1..20: mol_type = other DNA
tgtactcttcagagaagctg

SEQ ID NO: 168 - DNA, 20 bp, synthetic construct
  source 1..20: mol_type = other DNA
gttaggtgtgtgagacctct

SEQ ID NO: 169 - DNA, 20 bp, synthetic construct
  source 1..20: mol_type = other DNA
tctgtgagtgttctatttaa

SEQ ID NO: 170 - DNA, 20 bp, synthetic construct
  source 1..20: mol_type = other DNA
tggtgctatgtctatataca

SEQ ID NO: 171 - DNA, 20 bp, synthetic construct
  source 1..20: mol_type = other DNA
tggcctttatacttttgtaa

SEQ ID NO: 172 - DNA, 20 bp, synthetic construct
  source 1..20: mol_type = other DNA
tgtatatttgtctgttttgc

SEQ ID NO: 173 - DNA, 20 bp, synthetic construct
  source 1..20: mol_type = other DNA
cttcctttttttattttgag

SEQ ID NO: 174 - DNA, 20 bp, synthetic construct
  source 1..20: mol_type = other DNA
tctttattttataattaggt

SEQ ID NO: 175 - DNA, 20 bp, synthetic construct
  source 1..20: mol_type = other DNA
tctatggtcctcagtctcct

SEQ ID NO: 176 - DNA, 20 bp, synthetic construct
  source 1..20: mol_type = other DNA
gtgacactatttggtttcaa

SEQ ID NO: 177 - DNA, 20 bp, synthetic construct
  source 1..20: mol_type = other DNA
gcttttctacttcatcttct

SEQ ID NO: 178 - DNA, 20 bp, synthetic construct
  source 1..20: mol_type = other DNA
tgggcttttgatagtgttaa

SEQ ID NO: 179 - DNA, 20 bp, synthetic construct
  source 1..20: mol_type = other DNA
gttgctctggctgctgctcc

SEQ ID NO: 180 - DNA, 20 bp, synthetic construct
  source 1..20: mol_type = other DNA
tctctcttgttcctggtctg

SEQ ID NO: 181 - DNA, 20 bp, synthetic construct
  source 1..20: mol_type = other DNA
gcttgagtagaaagggtggc

SEQ ID NO: 182 - DNA, 20 bp, synthetic construct
  source 1..20: mol_type = other DNA
gtcacatttgatttctgtag

SEQ ID NO: 183 - DNA, 20 bp, synthetic construct
  source 1..20: mol_type = other DNA
tggttggatttcatttttcg

SEQ ID NO: 184 - DNA, 20 bp, synthetic construct
  source 1..20: mol_type = other DNA
gctgctgctgctcagccttg

SEQ ID NO: 185 - DNA, 20 bp, synthetic construct
  source 1..20: mol_type = other DNA
ggctgctctcagctttcttg

SEQ ID NO: 186 - DNA, 20 bp, synthetic construct
  source 1..20: mol_type = other DNA
gttgaagttctcgctcttgg

SEQ ID NO: 187 - DNA, 20 bp, synthetic construct
  source 1..20: mol_type = other DNA
ttctgtttttaagtcttcca

SEQ ID NO: 188 - DNA, 20 bp, synthetic construct
  source 1..20: mol_type = other DNA
cggcgaactgtatcacggcc

SEQ ID NO: 189 - DNA, 20 bp, synthetic construct
  source 1..20: mol_type = other DNA
actcccctggttgattccgt

SEQ ID NO: 190 - DNA, 20 bp, synthetic construct
  source 1..20: mol_type = other DNA
ctgtgttattttagcctaca

SEQ ID NO: 191 - DNA, 20 bp, synthetic construct
  source 1..20: mol_type = other DNA
gttcctgatgttgattttgc

SEQ ID NO: 192 - DNA, 20 bp, synthetic construct
  source 1..20: mol_type = other DNA
gtgttcgctctctccctctc

SEQ ID NO: 193 - DNA, 20 bp, synthetic construct
  source 1..20: mol_type = other DNA
tttttgtttttgttttttcc

SEQ ID NO: 194 - DNA, 20 bp, synthetic construct
  source 1..20: mol_type = other DNA
ggtcatttattgtcacatac

SEQ ID NO: 195 - DNA, 20 bp, synthetic construct
  source 1..20: mol_type = other DNA
actgcaggaatatcacacaa

SEQ ID NO: 196 - DNA, 20 bp, synthetic construct
  source 1..20: mol_type = other DNA
gtttagttgcagccatccaa

SEQ ID NO: 197 - DNA, 20 bp, synthetic construct
  source 1..20: mol_type = other DNA
gggttgataccagatttttt

SEQ ID NO: 198 - DNA, 20 bp, synthetic construct
  source 1..20: mol_type = other DNA
tggtgtgtgtttttctgagt

SEQ ID NO: 199 - DNA, 20 bp, synthetic construct
  source 1..20: mol_type = other DNA
attttataattcctatacct

SEQ ID NO: 200 - DNA, 20 bp, synthetic construct
  source 1..20: mol_type = other DNA
cattcactattccgtgtggt

SEQ ID NO: 201 - DNA, 20 bp, synthetic construct
  source 1..20: mol_type = other DNA
gtgattgtgttccattgtaa

SEQ ID NO: 202 - DNA, 20 bp, synthetic construct
  source 1..20: mol_type = other DNA
ttcttgtttgttggtttctt

SEQ ID NO: 203 - DNA, 20 bp, synthetic construct
  source 1..20: mol_type = other DNA
tcacaattccaagttagaaa

SEQ ID NO: 204 - DNA, 20 bp, synthetic construct
  source 1..20: mol_type = other DNA
gtaccgagagctctgcttcc

SEQ ID NO: 205 - DNA, 20 bp, synthetic construct
  source 1..20: mol_type = other DNA
gtgttcttaaattctctatt

SEQ ID NO: 206 - DNA, 20 bp, synthetic construct
  source 1..20: mol_type = other DNA
tgttttcttcagcttctcaa

SEQ ID NO: 207 - DNA, 20 bp, synthetic construct
  source 1..20: mol_type = other DNA
ctctgcttttttttttttac

SEQ ID NO: 208 - DNA, 20 bp, synthetic construct
  source 1..20: mol_type = other DNA
gtttagactaagaagggagc

SEQ ID NO: 209 - DNA, 20 bp, synthetic construct
  source 1..20: mol_type = other DNA
tccgtatttattctggcctc

SEQ ID NO: 210 - DNA, 20 bp, synthetic construct
  source 1..20: mol_type = other DNA
agatactacctattggccaa

SEQ ID NO: 211 - DNA, 20 bp, synthetic construct
  source 1..20: mol_type = other DNA
gcaccgagcttcttggtaac

SEQ ID NO: 212 - DNA, 20 bp, synthetic construct
  source 1..20: mol_type = other DNA
gttctggtgtctgttttccc

SEQ ID NO: 213 - DNA, 20 bp, synthetic construct
  source 1..20: mol_type = other DNA
gtacaatattttacactgga

SEQ ID NO: 214 - DNA, 20 bp, synthetic construct
  source 1..20: mol_type = other DNA
atttatttaaaacaattttg

SEQ ID NO: 215 - DNA, 20 bp, synthetic construct
  source 1..20: mol_type = other DNA
cttgtagtagtttttgtgag

SEQ ID NO: 216 - DNA, 20 bp, synthetic construct
  source 1..20: mol_type = other DNA
ggagggtgcttagtccttcc

SEQ ID NO: 217 - DNA, 20 bp, synthetic construct
  source 1..20: mol_type = other DNA
gtttggcacacagtaggtgc

SEQ ID NO: 218 - DNA, 20 bp, synthetic construct
  source 1..20: mol_type = other DNA
gtgactgctgctgatacctg

SEQ ID NO: 219 - DNA, 20 bp, synthetic construct
  source 1..20: mol_type = other DNA
gtttgatatgctatgctcac

SEQ ID NO: 220 - DNA, 20 bp, synthetic construct
  source 1..20: mol_type = other DNA
tgtttggttgaagtatgtgg

SEQ ID NO: 221 - DNA, 20 bp, synthetic construct
  source 1..20: mol_type = other DNA
atgtgggtatttaatgtttc

SEQ ID NO: 222 - DNA, 20 bp, synthetic construct
  source 1..20: mol_type = other DNA
gtctttctaaatggttgtac

SEQ ID NO: 223 - DNA, 20 bp, synthetic construct
  source 1..20: mol_type = other DNA
ttcagcatgatctcagttct

SEQ ID NO: 224 - DNA, 20 bp, synthetic construct
  source 1..20: mol_type = other DNA
atgacataattctaataact

SEQ ID NO: 225 - DNA, 20 bp, synthetic construct
  source 1..20: mol_type = other DNA
tctccttatcttgtcctctc

SEQ ID NO: 226 - DNA, 20 bp, synthetic construct
  source 1..20: mol_type = other DNA
tattatatattagactaata

SEQ ID NO: 227 - DNA, 20 bp, synthetic construct
  source 1..20: mol_type = other DNA
gttctattttataatagtag

SEQ ID NO: 228 - DNA, 20 bp, synthetic construct
  source 1..20: mol_type = other DNA
tgtgtaatactccatttttc

SEQ ID NO: 229 - DNA, 20 bp, synthetic construct
  source 1..20: mol_type = other DNA
gtttgtgttgtgttttacag

SEQ ID NO: 230 - DNA, 20 bp, synthetic construct
  source 1..20: mol_type = other DNA
gttttcatacacagttcttc

SEQ ID NO: 231 - DNA, 20 bp, synthetic construct
  source 1..20: mol_type = other DNA
attatattacattatacttg

SEQ ID NO: 232 - DNA, 20 bp, synthetic construct
  source 1..20: mol_type = other DNA
tcctgggtttttagttttcc

SEQ ID NO: 233 - DNA, 20 bp, synthetic construct
  source 1..20: mol_type = other DNA
tgaggattacatcagtgtaa

SEQ ID NO: 234 - DNA, 20 bp, synthetic construct
  source 1..20: mol_type = other DNA
tcttgggtagatgaggtttg

SEQ ID NO: 235 - DNA, 20 bp, synthetic construct
  source 1..20: mol_type = other DNA
tcttgttttttcctttcttg

SEQ ID NO: 236 - DNA, 20 bp, synthetic construct
  source 1..20: mol_type = other DNA
gtctcctttgttccgtgtac

SEQ ID NO: 237 - DNA, 20 bp, synthetic construct
  source 1..20: mol_type = other DNA
gtctttttatttctctgccc

SEQ ID NO: 238 - DNA, 20 bp, synthetic construct
  source 1..20: mol_type = other DNA
ttgcaagaaggtatgcctag

SEQ ID NO: 239 - DNA, 20 bp, synthetic construct
  source 1..20: mol_type = other DNA
tcctgtttacaacaaagctc

SEQ ID NO: 240 - DNA, 20 bp, synthetic construct
  source 1..20: mol_type = other DNA
tctttctttgctataatttc

SEQ ID NO: 241 - DNA, 20 bp, synthetic construct
  source 1..20: mol_type = other DNA
gtctgctgatctatctgttg

SEQ ID NO: 242 - DNA, 20 bp, synthetic construct
  source 1..20: mol_type = other DNA
attagtttatcttttttttc

SEQ ID NO: 243 - DNA, 20 bp, synthetic construct
  source 1..20: mol_type = other DNA
ctgtcagtagagagatttag

SEQ ID NO: 244 - DNA, 20 bp, synthetic construct
  source 1..20: mol_type = other DNA
tgcacatttctgaatttctc

SEQ ID NO: 245 - DNA, 20 bp, synthetic construct
  source 1..20: mol_type = other DNA
gtaccagctaatccattcaa

SEQ ID NO: 246 - DNA, 20 bp, synthetic construct
  source 1..20: mol_type = other DNA
tgttctgtataataatgtaa

SEQ ID NO: 247 - DNA, 20 bp, synthetic construct
  source 1..20: mol_type = other DNA
cgagagacccatttactgca

SEQ ID NO: 248 - DNA, 20 bp, synthetic construct
  source 1..20: mol_type = other DNA
tgggctcataattatttttt

SEQ ID NO: 249 - DNA, 20 bp, synthetic construct
  source 1..20: mol_type = other DNA
aagtcattttatgatcttgc

SEQ ID NO: 250 - DNA, 20 bp, synthetic construct
  source 1..20: mol_type = other DNA
atttacttgtatatttgtct

SEQ ID NO: 251 - DNA, 20 bp, synthetic construct
  source 1..20: mol_type = other DNA
gtttccatagcttccttttt

SEQ ID NO: 252 - DNA, 20 bp, synthetic construct
  source 1..20: mol_type = other DNA
tctcaaataggtacactcaa

SEQ ID NO: 253 - DNA, 20 bp, synthetic construct
  source 1..20: mol_type = other DNA
ttttgtttaaagggttttac

SEQ ID NO: 254 - DNA, 20 bp, synthetic construct
  source 1..20: mol_type = other DNA
gtgtgacactatttggtttc

SEQ ID NO: 255 - DNA, 20 bp, synthetic construct
  source 1..20: mol_type = other DNA
attgttgcttttctacttca

SEQ ID NO: 256 - DNA, 20 bp, synthetic construct
  source 1..20: mol_type = other DNA
aagtgggcttttgatagtgt

SEQ ID NO: 257 - DNA, 20 bp, synthetic construct
  source 1..20: mol_type = other DNA
tgctgttgctctggctgctg

SEQ ID NO: 258 - DNA, 20 bp, synthetic construct
  source 1..20: mol_type = other DNA
tctttctctcttgttcctgg

SEQ ID NO: 259 - DNA, 20 bp, synthetic construct
  source 1..20: mol_type = other DNA
tcttttcacgaagattttgc

SEQ ID NO: 260 - DNA, 20 bp, synthetic construct
  source 1..20: mol_type = other DNA
aagtcacatttgatttctgt

SEQ ID NO: 261 - DNA, 20 bp, synthetic construct
  source 1..20: mol_type = other DNA
tcttggttggatttcatttt

SEQ ID NO: 262 - DNA, 20 bp, synthetic construct
  source 1..20: mol_type = other DNA
tgaggtgctgctgctgctgc

SEQ ID NO: 263 - DNA, 20 bp, synthetic construct
  source 1..20: mol_type = other DNA
tggcctgctgcagccggctg

SEQ ID NO: 264 - DNA, 20 bp, synthetic construct
  source 1..20: mol_type = other DNA
ggttgaagttctcgctcttg

SEQ ID NO: 265 - DNA, 20 bp, synthetic construct
  source 1..20: mol_type = other DNA
tcttctgtttttaagtcttc

SEQ ID NO: 266 - DNA, 20 bp, synthetic construct
  source 1..20: mol_type = other DNA
tggctggttctctccggaca

SEQ ID NO: 267 - DNA, 20 bp, synthetic construct
  source 1..20: mol_type = other DNA
tgctgggttctattttggtg

SEQ ID NO: 268 - DNA, 20 bp, synthetic construct
  source 1..20: mol_type = other DNA
atgtaaatactgtgttattt

SEQ ID NO: 269 - DNA, 20 bp, synthetic construct
  source 1..20: mol_type = other DNA
ggttcctgatgttgattttg

SEQ ID NO: 270 - DNA, 20 bp, synthetic construct
  source 1..20: mol_type = other DNA
tgggtgttcgctctctccct

SEQ ID NO: 271 - DNA, 20 bp, synthetic construct
  source 1..20: mol_type = other DNA
aaagcaacttagtttttttt

SEQ ID NO: 272 - DNA, 20 bp, synthetic construct
  source 1..20: mol_type = other DNA
gtagtacttggtggtcattt

SEQ ID NO: 273 - DNA, 20 bp, synthetic construct
  source 1..20: mol_type = other DNA
tgctacatttatttatgctc

SEQ ID NO: 274 - DNA, 20 bp, synthetic construct
  source 1..20: mol_type = other DNA
tgttcagtttagttgcagcc

SEQ ID NO: 275 - DNA, 20 bp, synthetic construct
  source 1..20: mol_type = other DNA
aatactagacagccaaaatg

SEQ ID NO: 276 - DNA, 20 bp, synthetic construct
  source 1..20: mol_type = other DNA
aggtggtgtgtgtttttctg

SEQ ID NO: 277 - DNA, 20 bp, synthetic construct
  source 1..20: mol_type = other DNA
attattttataattcctata

SEQ ID NO: 278 - DNA, 20 bp, synthetic construct
  source 1..20: mol_type = other DNA
tccaggctacatggctccag

SEQ ID NO: 279 - DNA, 20 bp, synthetic construct
  source 1..20: mol_type = other DNA
atttttttcttttcgccctg

SEQ ID NO: 280 - DNA, 20 bp, synthetic construct
  source 1..20: mol_type = other DNA
aggttcttgtttgttggttt

SEQ ID NO: 281 - DNA, 20 bp, synthetic construct
  source 1..20: mol_type = other DNA
atagaggctcacaattccaa

SEQ ID NO: 282 - DNA, 20 bp, synthetic construct
  source 1..20: mol_type = other DNA
tgttgagctgcttgtggttc

SEQ ID NO: 283 - DNA, 20 bp, synthetic construct
  source 1..20: mol_type = other DNA
tgatgtgttcttaaattctc

SEQ ID NO: 284 - DNA, 20 bp, synthetic construct
  source 1..20: mol_type = other DNA
ttttgttttcttcagcttct

SEQ ID NO: 285 - DNA, 20 bp, synthetic construct
  source 1..20: mol_type = other DNA
ttctctgctttttttttttt

SEQ ID NO: 286 - DNA, 20 bp, synthetic construct
  source 1..20: mol_type = other DNA
caagattatattctttgggt

SEQ ID NO: 287 - DNA, 20 bp, synthetic construct
  source 1..20: mol_type = other DNA
tgctccgtatttattctggc

SEQ ID NO: 288 - DNA, 20 bp, synthetic construct
  source 1..20: mol_type = other DNA
gttattgtatagatactacc

SEQ ID NO: 289 - DNA, 20 bp, synthetic construct
  source 1..20: mol_type = other DNA
gcactaactaaaggatttac

SEQ ID NO: 290 - DNA, 20 bp, synthetic construct
  source 1..20: mol_type = other DNA
aacccaagttctggtgtctg

SEQ ID NO: 291 - DNA, 20 bp, synthetic construct
  source 1..20: mol_type = other DNA
gtgcaagtacaatattttac

SEQ ID NO: 292 - DNA, 20 bp, synthetic construct
  source 1..20: mol_type = other DNA
attttattagtacgagtata

SEQ ID NO: 293 - DNA, 20 bp, synthetic construct
  source 1..20: mol_type = other DNA
gtgcttgtagtagtttttgt

SEQ ID NO: 294 - DNA, 20 bp, synthetic construct
  source 1..20: mol_type = other DNA
gttagtggagggtgcttagt

SEQ ID NO: 295 - DNA, 20 bp, synthetic construct
  source 1..20: mol_type = other DNA
tcctgttattttggtactgg

SEQ ID NO: 296 - DNA, 20 bp, synthetic construct
  source 1..20: mol_type = other DNA
gtttgcctactcctggtctg

SEQ ID NO: 297 - DNA, 20 bp, synthetic construct
  source 1..20: mol_type = other DNA
gttgactatcttattttttc

SEQ ID NO: 298 - DNA, 20 bp, synthetic construct
  source 1..20: mol_type = other DNA
tcttgcttttaatttttttg

SEQ ID NO: 299 - DNA, 20 bp, synthetic construct
  source 1..20: mol_type = other DNA
gttcacctacatgtttcccc

SEQ ID NO: 300 - DNA, 20 bp, synthetic construct
  source 1..20: mol_type = other DNA
tcttttttttttaattacag

SEQ ID NO: 301 - DNA, 20 bp, synthetic construct
  source 1..20: mol_type = other DNA
tggtgcactcagctctacct

SEQ ID NO: 302 - DNA, 20 bp, synthetic construct
  source 1..20: mol_type = other DNA
aaaaatcctgatcaaaaaaa

SEQ ID NO: 303 - DNA, 20 bp, synthetic construct
  source 1..20: mol_type = other DNA
ggctccatactccattctgt

SEQ ID NO: 304 - DNA, 20 bp, synthetic construct
  source 1..20: mol_type = other DNA
tgtataatattccattctgt

SEQ ID NO: 305 - DNA, 20 bp, synthetic construct
  source 1..20: mol_type = other DNA
attttattacatttttcttg

SEQ ID NO: 306 - DNA, 20 bp, synthetic construct
  source 1..20: mol_type = other DNA
tctatgttagtcatttctct

SEQ ID NO: 307 - DNA, 20 bp, synthetic construct
  source 1..20: mol_type = other DNA
tcttgacatgatgtttccct

SEQ ID NO: 308 - DNA, 20 bp, synthetic construct
  source 1..20: mol_type = other DNA
attaccttaaaactaccttg

SEQ ID NO: 309 - DNA, 20 bp, synthetic construct
  source 1..20: mol_type = other DNA
taagccatgcctggacttcg

SEQ ID NO: 310 - DNA, 20 bp, synthetic construct
  source 1..20: mol_type = other DNA
gtttgcattaaatgactgtg

SEQ ID NO: 311 - DNA, 20 bp, synthetic construct
  source 1..20: mol_type = other DNA
tgtttgatatttcttttttt

SEQ ID NO: 312 - DNA, 20 bp, synthetic construct
  source 1..20: mol_type = other DNA
tcttgggtaactagatgatg

SEQ ID NO: 313 - DNA, 20 bp, synthetic construct
  source 1..20: mol_type = other DNA
gtttttttttttatttgcct

SEQ ID NO: 314 - DNA, 20 bp, synthetic construct
  source 1..20: mol_type = other DNA
gtcaggttataatgaccctg

SEQ ID NO: 315 - DNA, 20 bp, synthetic construct
  source 1..20: mol_type = other DNA
tcttctgtatttaattcttc

SEQ ID NO: 316 - DNA, 20 bp, synthetic construct
  source 1..20: mol_type = other DNA
gttattgtgtttatattcag

SEQ ID NO: 317 - DNA, 20 bp, synthetic construct
  source 1..20: mol_type = other DNA
tggtgacatcttgtttctac

SEQ ID NO: 318 - DNA, 20 bp, synthetic construct
  source 1..20: mol_type = other DNA
tgagccactgtgtgtagcca

SEQ ID NO: 319 - DNA, 20 bp, synthetic construct
  source 1..20: mol_type = other DNA
ttgtctgctgatctatctgt

SEQ ID NO: 320 - DNA, 20 bp, synthetic construct
  source 1..20: mol_type = other DNA
gttttttatttttaaattag

SEQ ID NO: 321 - DNA, 20 bp, synthetic construct
  source 1..20: mol_type = other DNA
ccttgcacttttgtttctac

SEQ ID NO: 322 - DNA, 20 bp, synthetic construct
  source 1..20: mol_type = other DNA
tcagtacatgttcatcttaa

SEQ ID NO: 323 - DNA, 20 bp, synthetic construct
  source 1..20: mol_type = other DNA
cggcatgttcaatgttggca

SEQ ID NO: 324 - DNA, 20 bp, synthetic construct
  source 1..20: mol_type = other DNA
gtgagctattatggtgtcac

SEQ ID NO: 325 - DNA, 20 bp, synthetic construct
  source 1..20: mol_type = other DNA
gtctgctttcctggaaggct

SEQ ID NO: 326 - DNA, 20 bp, synthetic construct
  source 1..20: mol_type = other DNA
atccccctaaatcgactcct

SEQ ID NO: 327 - DNA, 20 bp, synthetic construct
  source 1..20: mol_type = other DNA
gttattttctctccactctc

SEQ ID NO: 328 - DNA, 20 bp, synthetic construct
  source 1..20: mol_type = other DNA
attcttttttatttacttgt

SEQ ID NO: 329 - DNA, 20 bp, synthetic construct
  source 1..20: mol_type = other DNA
tctagtttccatagcttcct

SEQ ID NO: 330 - DNA, 20 bp, synthetic construct
  source 1..20: mol_type = other DNA
tctttgtttctttttgccta

SEQ ID NO: 331 - DNA, 20 bp, synthetic construct
  source 1..20: mol_type = other DNA
tccatttttgtttaaagggt

SEQ ID NO: 332 - DNA, 20 bp, synthetic construct
  source 1..20: mol_type = other DNA
tggtacagataattgtgatg

SEQ ID NO: 333 - DNA, 20 bp, synthetic construct
  source 1..20: mol_type = other DNA
tggattttatacacattcag

SEQ ID NO: 334 - DNA, 20 bp, synthetic construct
  source 1..20: mol_type = other DNA
cttagattttatgagctcaa

SEQ ID NO: 335 - DNA, 20 bp, synthetic construct
  source 1..20: mol_type = other DNA
gctgctgttgctctggctgc

SEQ ID NO: 336 - DNA, 20 bp, synthetic construct
  source 1..20: mol_type = other DNA
ctctttctctcttgttcctg

SEQ ID NO: 337 - DNA, 20 bp, synthetic construct
  source 1..20: mol_type = other DNA
accataagctatcagttcct

SEQ ID NO: 338 - DNA, 20 bp, synthetic construct
  source 1..20: mol_type = other DNA
gtctggatggctctgatttt

SEQ ID NO: 339 - DNA, 20 bp, synthetic construct
  source 1..20: mol_type = other DNA
tccgctcttggttggatttc

SEQ ID NO: 340 - DNA, 20 bp, synthetic construct
  source 1..20: mol_type = other DNA
tgctgaggtgctgctgctgc

SEQ ID NO: 341 - DNA, 20 bp, synthetic construct
  source 1..20: mol_type = other DNA
gttcaggacctccttggcct

SEQ ID NO: 342 - DNA, 20 bp, synthetic construct
  source 1..20: mol_type = other DNA
ctcagggttgaagttctcgc

SEQ ID NO: 343 - DNA, 20 bp, synthetic construct
  source 1..20: mol_type = other DNA
tgcactctggatgaaatctt

SEQ ID NO: 344 - DNA, 20 bp, synthetic construct
  source 1..20: mol_type = other DNA
cttcaggttcttgagggtaa

SEQ ID NO: 345 - DNA, 20 bp, synthetic construct
  source 1..20: mol_type = other DNA
gcttgctgggttctattttg

SEQ ID NO: 346 - DNA, 20 bp, synthetic construct
  source 1..20: mol_type = other DNA
cctgctgtaactctaatgac

SEQ ID NO: 347 - DNA, 20 bp, synthetic construct
  source 1..20: mol_type = other DNA
tggttaactttccaaatctg

SEQ ID NO: 348 - DNA, 20 bp, synthetic construct
  source 1..20: mol_type = other DNA
gttttcctaacactgcacag

SEQ ID NO: 349 - DNA, 20 bp, synthetic construct
  source 1..20: mol_type = other DNA
atgtagttacagtgttgaaa

SEQ ID NO: 350 - DNA, 20 bp, synthetic construct
  source 1..20: mol_type = other DNA
caggtagtacttggtggtca

SEQ ID NO: 351 - DNA, 20 bp, synthetic construct
  source 1..20: mol_type = other DNA
attttgctacatttatttat

SEQ ID NO: 352 - DNA, 20 bp, synthetic construct
  source 1..20: mol_type = other DNA
gtatttgttcagtttagttg

SEQ ID NO: 353 - DNA, 20 bp, synthetic construct
  source 1..20: mol_type = other DNA
gctattctaaacctattcaa

SEQ ID NO: 354 - DNA, 20 bp, synthetic construct
  source 1..20: mol_type = other DNA
ggtttagtggatccagtcaa

SEQ ID NO: 355 - DNA, 20 bp, synthetic construct
  source 1..20: mol_type = other DNA
aagtgtttagaaagaaccaa

SEQ ID NO: 356 - DNA, 20 bp, synthetic construct
  source 1..20: mol_type = other DNA
tggcaggtggtcccctccac

SEQ ID NO: 357 - DNA, 20 bp, synthetic construct
  source 1..20: mol_type = other DNA
atagtattatttttttcttt

SEQ ID NO: 358 - DNA, 20 bp, synthetic construct
  source 1..20: mol_type = other DNA
agagaggttcttgtttgttg

SEQ ID NO: 359 - DNA, 20 bp, synthetic construct
  source 1..20: mol_type = other DNA
tgctgccacttcctggtggg

SEQ ID NO: 360 - DNA, 20 bp, synthetic construct
  source 1..20: mol_type = other DNA
gtctgttgagctgcttgtgg

SEQ ID NO: 361 - DNA, 20 bp, synthetic construct
  source 1..20: mol_type = other DNA
ctctgtatatttattacttg

SEQ ID NO: 362 - DNA, 20 bp, synthetic construct
  source 1..20: mol_type = other DNA
attttgttttcttcagcttc

SEQ ID NO: 363 - DNA, 20 bp, synthetic construct
  source 1..20: mol_type = other DNA
ccttctctgctttttttttt

SEQ ID NO: 364 - DNA, 20 bp, synthetic construct
  source 1..20: mol_type = other DNA
gttcaagattatattctttg

SEQ ID NO: 365 - DNA, 20 bp, synthetic construct
  source 1..20: mol_type = other DNA
gtccggcttgatttttggac

SEQ ID NO: 366 - DNA, 20 bp, synthetic construct
  source 1..20: mol_type = other DNA
ttgttgttattgtatagata

SEQ ID NO: 367 - DNA, 20 bp, synthetic construct
  source 1..20: mol_type = other DNA
tttagagttgagcagttcag

SEQ ID NO: 368 - DNA, 20 bp, synthetic construct
  source 1..20: mol_type = other DNA
tgtcagtctggtagtgccct

SEQ ID NO: 369 - DNA, 20 bp, synthetic construct
  source 1..20: mol_type = other DNA
attttttaatatttgtttaa

SEQ ID NO: 370 - DNA, 20 bp, synthetic construct
  source 1..20: mol_type = other DNA
gttattttattagtacgagt

SEQ ID NO: 371 - DNA, 20 bp, synthetic construct
  source 1..20: mol_type = other DNA
ggtgcttgtagtagtttttg

SEQ ID NO: 372 - DNA, 20 bp, synthetic construct
  source 1..20: mol_type = other DNA
tcctccttttatatctgttt

SEQ ID NO: 373 - DNA, 20 bp, synthetic construct
  source 1..20: mol_type = other DNA
gtttgattactgtcatgact

SEQ ID NO: 374 - DNA, 20 bp, synthetic construct
  source 1..20: mol_type = other DNA
gtgaaaagaaagatgtactt

SEQ ID NO: 375 - DNA, 20 bp, synthetic construct
  source 1..20: mol_type = other DNA
cgttgactatcttatttttt

SEQ ID NO: 376 - DNA, 20 bp, synthetic construct
  source 1..20: mol_type = other DNA
tctcaattataatttgtttt

SEQ ID NO: 377 - DNA, 20 bp, synthetic construct
  source 1..20: mol_type = other DNA
gtttccttaaaagcaactgt

SEQ ID NO: 378 - DNA, 20 bp, synthetic construct
  source 1..20: mol_type = other DNA
agagtcaatgattaaattca

SEQ ID NO: 379 - DNA, 20 bp, synthetic construct
  source 1..20: mol_type = other DNA
catgactctttcttaagaat

SEQ ID NO: 380 - DNA, 20 bp, synthetic construct
  source 1..20: mol_type = other DNA
aaattttctagaaacattaa

SEQ ID NO: 381 - DNA, 20 bp, synthetic construct
  source 1..20: mol_type = other DNA
gttaccattctcctttcccc

SEQ ID NO: 382 - DNA, 20 bp, synthetic construct
  source 1..20: mol_type = other DNA
tgctagctacagagcactga

SEQ ID NO: 383 - DNA, 20 bp, synthetic construct
  source 1..20: mol_type = other DNA
cgttggatattttattcttt

SEQ ID NO: 384 - DNA, 20 bp, synthetic construct
  source 1..20: mol_type = other DNA
atgtttgtattccatatttg

SEQ ID NO: 385 - DNA, 20 bp, synthetic construct
  source 1..20: mol_type = other DNA
tcttttcatcttcagctctg

SEQ ID NO: 386 - DNA, 20 bp, synthetic construct
  source 1..20: mol_type = other DNA
gtttgtgcttttggtgtcac

SEQ ID NO: 387 - DNA, 20 bp, synthetic construct
  source 1..20: mol_type = other DNA
gtttgctttcttcatcctac

SEQ ID NO: 388 - DNA, 20 bp, synthetic construct
  source 1..20: mol_type = other DNA
aatcgcagggaggattgaaa

SEQ ID NO: 389 - DNA, 20 bp, synthetic construct
  source 1..20: mol_type = other DNA
tgacctttatttggatcttg

SEQ ID NO: 390 - DNA, 20 bp, synthetic construct
  source 1..20: mol_type = other DNA
tggcatttataatatttgtg

SEQ ID NO: 391 - DNA, 20 bp, synthetic construct
  source 1..20: mol_type = other DNA
attttcttagaaggatctct

SEQ ID NO: 392 - DNA, 20 bp, synthetic construct
  source 1..20: mol_type = other DNA
gtttgaactgagcatgtttt

SEQ ID NO: 393 - DNA, 20 bp, synthetic construct
  source 1..20: mol_type = other DNA
tggtcattagatcatgctac

SEQ ID NO: 394 - DNA, 20 bp, synthetic construct
  source 1..20: mol_type = other DNA
tgtagcttttagtgactttg

SEQ ID NO: 395 - DNA, 20 bp, synthetic construct
  source 1..20: mol_type = other DNA
attttggctttccatagtgt

SEQ ID NO: 396 - DNA, 20 bp, synthetic construct
  source 1..20: mol_type = other DNA
gttactgctgctgtgtgggc

SEQ ID NO: 397 - DNA, 20 bp, synthetic construct
  source 1..20: mol_type = other DNA
ctaggattagctaattccta

SEQ ID NO: 398 - DNA, 20 bp, synthetic construct
  source 1..20: mol_type = other DNA
tctctactaaaatgtttttt

SEQ ID NO: 399 - DNA, 20 bp, synthetic construct
  source 1..20: mol_type = other DNA
ggagtattttagctgtgatg

SEQ ID NO: 400 - DNA, 20 bp, synthetic construct
  source 1..20: mol_type = other DNA
gcttcctttggtgcacgcag

SEQ ID NO: 401 - DNA, 20 bp, synthetic construct
  source 1..20: mol_type = other DNA
gtttgacatagtttctctgt

SEQ ID NO: 402 - DNA, 20 bp, synthetic construct
  source 1..20: mol_type = other DNA
tggtgtgtacttgtggtccc

SEQ ID NO: 403 - DNA, 20 bp, synthetic construct
  source 1..20: mol_type = other DNA
gtttcagtaagtatgtcttg

SEQ ID NO: 404 - DNA, 20 bp, synthetic construct
  source 1..20: mol_type = other DNA
gttataagagatctgcctac

SEQ ID NO: 405 - DNA, 20 bp, synthetic construct
  source 1..20: mol_type = other DNA
atcacacttcagttattttc

SEQ ID NO: 406 - DNA, 20 bp, synthetic construct
  source 1..20: mol_type = other DNA
tcttcttatgcattcttttt

SEQ ID NO: 407 - DNA, 20 bp, synthetic construct
  source 1..20: mol_type = other DNA
ccacccactgtccttttcag

SEQ ID NO: 408 - DNA, 20 bp, synthetic construct
  source 1..20: mol_type = other DNA
attcttctttaatcacttca

SEQ ID NO: 409 - DNA, 20 bp, synthetic construct
  source 1..20: mol_type = other DNA
gtttgcttattcttgcccaa

SEQ ID NO: 410 - DNA, 20 bp, synthetic construct
  source 1..20: mol_type = other DNA
tccatggtacagataattgt

SEQ ID NO: 411 - DNA, 20 bp, synthetic construct
  source 1..20: mol_type = other DNA
gttggattctttttttcttt

SEQ ID NO: 412 - DNA, 20 bp, synthetic construct
  source 1..20: mol_type = other DNA
tctatagctggtctctgtta

SEQ ID NO: 413 - DNA, 20 bp, synthetic construct
  source 1..20: mol_type = other DNA
cttgcggctgctgttgctct

SEQ ID NO: 414 - DNA, 20 bp, synthetic construct
  source 1..20: mol_type = other DNA
actctttctctcttgttcct

SEQ ID NO: 415 - DNA, 20 bp, synthetic construct
  source 1..20: mol_type = other DNA
gtaccatgtgctttcatcac

SEQ ID NO: 416 - DNA, 20 bp, synthetic construct
  source 1..20: mol_type = other DNA
gtttcactgtctggatggct

SEQ ID NO: 417 - DNA, 20 bp, synthetic construct
  source 1..20: mol_type = other DNA
tgctccgctcttggttggat

SEQ ID NO: 418 - DNA, 20 bp, synthetic construct
  source 1..20: mol_type = other DNA
gtactggttctgctgggctg

SEQ ID NO: 419 - DNA, 20 bp, synthetic construct
  source 1..20: mol_type = other DNA
gccggctcttctccatctca

SEQ ID NO: 420 - DNA, 20 bp, synthetic construct
  source 1..20: mol_type = other DNA
ccttctttagctccccgttg

SEQ ID NO: 421 - DNA, 20 bp, synthetic construct
  source 1..20: mol_type = other DNA
tgcttatctctgcactctgg

SEQ ID NO: 422 - DNA, 20 bp, synthetic construct
  source 1..20: mol_type = other DNA
agagccgttcttcaggttct

SEQ ID NO: 423 - DNA, 20 bp, synthetic construct
  source 1..20: mol_type = other DNA
gccgaccacctcctcttcct

SEQ ID NO: 424 - DNA, 20 bp, synthetic construct
  source 1..20: mol_type = other DNA
tgcaccagtctcctgcgaca

SEQ ID NO: 425 - DNA, 20 bp, synthetic construct
  source 1..20: mol_type = other DNA
tgttcttttaaatggttaac

SEQ ID NO: 426 - DNA, 20 bp, synthetic construct
  source 1..20: mol_type = other DNA
gtttgcatctacctcttggg

SEQ ID NO: 427 - DNA, 20 bp, synthetic construct
  source 1..20: mol_type = other DNA
tgcagagctgaaatgtagtt

SEQ ID NO: 428 - DNA, 20 bp, synthetic construct
  source 1..20: mol_type = other DNA
cgtcaggtagtacttggtgg

SEQ ID NO: 429 - DNA, 20 bp, synthetic construct
  source 1..20: mol_type = other DNA
aatggcctagagtttaggca

SEQ ID NO: 430 - DNA, 20 bp, synthetic construct
  source 1..20: mol_type = other DNA
caggtatttgttcagtttag

SEQ ID NO: 431 - DNA, 20 bp, synthetic construct
  source 1..20: mol_type = other DNA
tcctcttaccatcaaaggct

SEQ ID NO: 432 - DNA, 20 bp, synthetic construct
  source 1..20: mol_type = other DNA
tgttggtttagtggatccag

SEQ ID NO: 433 - DNA, 20 bp, synthetic construct
  source 1..20: mol_type = other DNA
tggcacagaaagtattgcac

SEQ ID NO: 434 - DNA, 20 bp, synthetic construct
  source 1..20: mol_type = other DNA
gtggtgaccgtgggtggcag

SEQ ID NO: 435 - DNA, 20 bp, synthetic construct
  source 1..20: mol_type = other DNA
gtttcttattaatagtatta

SEQ ID NO: 436 - DNA, 20 bp, synthetic construct
  source 1..20: mol_type = other DNA
gtcattttatatatttagaa

SEQ ID NO: 437 - DNA, 20 bp, synthetic construct
  source 1..20: mol_type = other DNA
ggagggatgctgccacttcc

SEQ ID NO: 438 - DNA, 20 bp, synthetic construct
  source 1..20: mol_type = other DNA
cagtctgttgagctgcttgt

SEQ ID NO: 439 - DNA, 20 bp, synthetic construct
  source 1..20: mol_type = other DNA
ttctctgtatatttattact

SEQ ID NO: 440 - DNA, 20 bp, synthetic construct
  source 1..20: mol_type = other DNA
cttcaaaattttgttttctt

SEQ ID NO: 441 - DNA, 20 bp, synthetic construct
  source 1..20: mol_type = other DNA
tgacaaatttctatatacaa

SEQ ID NO: 442 - DNA, 20 bp, synthetic construct
  source 1..20: mol_type = other DNA
tgagtcctgtttgattggta

SEQ ID NO: 443 - DNA, 20 bp, synthetic construct
  source 1..20: mol_type = other DNA
gtttccactgtccggcttga

SEQ ID NO: 444 - DNA, 20 bp, synthetic construct
  source 1..20: mol_type = other DNA
tcttagagattgttgttatt

SEQ ID NO: 445 - DNA, 20 bp, synthetic construct
  source 1..20: mol_type = other DNA
atttgggtttagagttgagc

SEQ ID NO: 446 - DNA, 20 bp, synthetic construct
  source 1..20: mol_type = other DNA
tccctagttctcctctgtac

SEQ ID NO: 447 - DNA, 20 bp, synthetic construct
  source 1..20: mol_type = other DNA
tccattttttaatatttgtt

SEQ ID NO: 448 - DNA, 20 bp, synthetic construct
  source 1..20: mol_type = other DNA
ctgttattttattagtacga

SEQ ID NO: 449 - DNA, 20 bp, synthetic construct
  source 1..20: mol_type = other DNA
tggtgcttgtagtagttttt

SEQ ID NO: 450 - DNA, 20 bp, synthetic construct
  source 1..20: mol_type = other DNA
tcttcattttaatgttgttt

SEQ ID NO: 451 - DNA, 20 bp, synthetic construct
  source 1..20: mol_type = other DNA
tctgctctaaaactttctac

SEQ ID NO: 452 - DNA, 20 bp, synthetic construct
  source 1..20: mol_type = other DNA
ttattagtgaaaagaaagat

SEQ ID NO: 453 - DNA, 20 bp, synthetic construct
  source 1..20: mol_type = other DNA
attcagatataattgtttac

SEQ ID NO: 454 - DNA, 20 bp, synthetic construct
  source 1..20: mol_type = other DNA
gtgtgaataactaattcctt

SEQ ID NO: 455 - DNA, 20 bp, synthetic construct
  source 1..20: mol_type = other DNA
tgtttgataaatgttattct

SEQ ID NO: 456 - DNA, 20 bp, synthetic construct
  source 1..20: mol_type = other DNA
tattatattaaaagttaaaa

SEQ ID NO: 457 - DNA, 20 bp, synthetic construct
  source 1..20: mol_type = other DNA
agaggcttctggaaatcccc

SEQ ID NO: 458 - DNA, 20 bp, synthetic construct
  source 1..20: mol_type = other DNA
cctgtcttgataaaataaaa

SEQ ID NO: 459 - DNA, 20 bp, synthetic construct
  source 1..20: mol_type = other DNA
tgcatctattttctattctg

SEQ ID NO: 460 - DNA, 20 bp, synthetic construct
  source 1..20: mol_type = other DNA
gaaaattcctactcattttt

SEQ ID NO: 461 - DNA, 20 bp, synthetic construct
  source 1..20: mol_type = other DNA
gtttctgctaatctgtgaca

SEQ ID NO: 462 - DNA, 20 bp, synthetic construct
  source 1..20: mol_type = other DNA
gtttgcagttaacttttttt

SEQ ID NO: 463 - DNA, 20 bp, synthetic construct
  source 1..20: mol_type = other DNA
tggttatttactcattctac

SEQ ID NO: 464 - DNA, 20 bp, synthetic construct
  source 1..20: mol_type = other DNA
tcttttcataagcttattgg

SEQ ID NO: 465 - DNA, 20 bp, synthetic construct
  source 1..20: mol_type = other DNA
gtctgctttcaatgaagcac

SEQ ID NO: 466 - DNA, 20 bp, synthetic construct
  source 1..20: mol_type = other DNA
actttcctgtcttacaagag

SEQ ID NO: 467 - DNA, 20 bp, synthetic construct
  source 1..20: mol_type = other DNA
gtgagaactgctattttcag

SEQ ID NO: 468 - DNA, 20 bp, synthetic construct
  source 1..20: mol_type = other DNA
tcagctgtacagctccttac

SEQ ID NO: 469 - DNA, 20 bp, synthetic construct
  source 1..20: mol_type = other DNA
tggtcattatctagtttctg

SEQ ID NO: 470 - DNA, 20 bp, synthetic construct
  source 1..20: mol_type = other DNA
gtgtgtctagtttgtttttc

SEQ ID NO: 471 - DNA, 20 bp, synthetic construct
  source 1..20: mol_type = other DNA
gttatatatttcctattttc

SEQ ID NO: 472 - DNA, 20 bp, synthetic construct
  source 1..20: mol_type = other DNA
tctatatattaatcatttcc

SEQ ID NO: 473 - DNA, 20 bp, synthetic construct
  source 1..20: mol_type = other DNA
gggttatatcatgttggcca

SEQ ID NO: 474 - DNA, 20 bp, synthetic construct
  source 1..20: mol_type = other DNA
cggtgtggtgtcccatccct

SEQ ID NO: 475 - DNA, 20 bp, synthetic construct
  source 1..20: mol_type = other DNA
ctttgatattttagtgtctt

SEQ ID NO: 476 - DNA, 20 bp, synthetic construct
  source 1..20: mol_type = other DNA
tcctgattttcttttttttt

SEQ ID NO: 477 - DNA, 20 bp, synthetic construct
  source 1..20: mol_type = other DNA
tgctctctgtctgagtctcc

SEQ ID NO: 478 - DNA, 20 bp, synthetic construct
  source 1..20: mol_type = other DNA
gtgccagttcctgcattttc

SEQ ID NO: 479 - DNA, 20 bp, synthetic construct
  source 1..20: mol_type = other DNA
gtggtttgacatagtttctc

SEQ ID NO: 480 - DNA, 20 bp, synthetic construct
  source 1..20: mol_type = other DNA
gtttttcttacacatggtag

SEQ ID NO: 481 - DNA, 20 bp, synthetic construct
  source 1..20: mol_type = other DNA
ggtttcagtaagtatgtctt

SEQ ID NO: 482 - DNA, 20 bp, synthetic construct
  source 1..20: mol_type = other DNA
tgtggttataagagatctgc

SEQ ID NO: 483 - DNA, 20 bp, synthetic construct
  source 1..20: mol_type = other DNA
tcatgattttattgaatcac

SEQ ID NO: 484 - DNA, 20 bp, synthetic construct
  source 1..20: mol_type = other DNA
tctttataccagggatcccc

SEQ ID NO: 485 - DNA, 20 bp, synthetic construct
  source 1..20: mol_type = other DNA
tcatactttcttccgctctt

SEQ ID NO: 486 - DNA, 20 bp, synthetic construct
  source 1..20: mol_type = other DNA
gggtttcattcaccatgttg

SEQ ID NO: 487 - DNA, 20 bp, synthetic construct
  source 1..20: mol_type = other DNA
cggtttgcttattcttgccc

SEQ ID NO: 488 - DNA, 20 bp, synthetic construct
  source 1..20: mol_type = other DNA
attttcttttttctgtgcct

SEQ ID NO: 489 - DNA, 20 bp, synthetic construct
  source 1..20: mol_type = other DNA
tgttggattctttttttctt

SEQ ID NO: 490 - DNA, 20 bp, synthetic construct
  source 1..20: mol_type = other DNA
tgggttgtacctctacttgc

SEQ ID NO: 491 - DNA, 20 bp, synthetic construct
  source 1..20: mol_type = other DNA
tggtgacttgatgcacgatg

SEQ ID NO: 492 - DNA, 20 bp, synthetic construct
  source 1..20: mol_type = other DNA
tccactctttctctcttgtt

SEQ ID NO: 493 - DNA, 20 bp, synthetic construct
  source 1..20: mol_type = other DNA
tctttcttcctttcacagag

SEQ ID NO: 494 - DNA, 20 bp, synthetic construct
  source 1..20: mol_type = other DNA
gtgactgtttcactgtctgg

SEQ ID NO: 495 - DNA, 20 bp, synthetic construct
  source 1..20: mol_type = other DNA
cgttgctccgctcttggttg

SEQ ID NO: 496 - DNA, 20 bp, synthetic construct
  source 1..20: mol_type = other DNA
ggtggcctcccgagggacaa

SEQ ID NO: 497 - DNA, 20 bp, synthetic construct
  source 1..20: mol_type = other DNA
atcacgactgctgtagtctg

SEQ ID NO: 498 - DNA, 20 bp, synthetic construct
  source 1..20: mol_type = other DNA
tccaccttctttagctcccc

SEQ ID NO: 499 - DNA, 20 bp, synthetic construct
  source 1..20: mol_type = other DNA
cgttgcttatctctgcactc

SEQ ID NO: 500 - DNA, 20 bp, synthetic construct
  source 1..20: mol_type = other DNA
gtgtctgctgcccgccaggc

SEQ ID NO: 501 - DNA, 20 bp, synthetic construct
  source 1..20: mol_type = other DNA
ttctgacttctccagtttgc

SEQ ID NO: 502 - DNA, 20 bp, synthetic construct
  source 1..20: mol_type = other DNA
gtgcccttcctcccgcccgc

SEQ ID NO: 503 - DNA, 20 bp, synthetic construct
  source 1..20: mol_type = other DNA
tttattgtaaaatatgttgg

SEQ ID NO: 504 - DNA, 20 bp, synthetic construct
  source 1..20: mol_type = other DNA
ggcagtttgcatctacctct

SEQ ID NO: 505 - DNA, 20 bp, synthetic construct
  source 1..20: mol_type = other DNA
cttgctcttcagcaattctg

SEQ ID NO: 506 - DNA, 20 bp, synthetic construct
  source 1..20: mol_type = other DNA
atgccttgaactgattctca

SEQ ID NO: 507 - DNA, 20 bp, synthetic construct
  source 1..20: mol_type = other DNA
ctcacatatataaatgtctt

SEQ ID NO: 508 - DNA, 20 bp, synthetic construct
  source 1..20: mol_type = other DNA
aaagtactattttcaatggg

SEQ ID NO: 509 - DNA, 20 bp, synthetic construct
  source 1..20: mol_type = other DNA
cagcccgtattcctcttacc

SEQ ID NO: 510 - DNA, 20 bp, synthetic construct
  source 1..20: mol_type = other DNA
gtgttggtttagtggatcca

SEQ ID NO: 511 - DNA, 20 bp, synthetic construct
  source 1..20: mol_type = other DNA
tggtcagactctattggcac

SEQ ID NO: 512 - DNA, 20 bp, synthetic construct
  source 1..20: mol_type = other DNA
tgtttgctacacagaagcgg

SEQ ID NO: 513 - DNA, 20 bp, synthetic construct
  source 1..20: mol_type = other DNA
tggtttcttattaatagtat

SEQ ID NO: 514 - DNA, 20 bp, synthetic construct
  source 1..20: mol_type = other DNA
cagtcattttatatatttag

SEQ ID NO: 515 - DNA, 20 bp, synthetic construct
  source 1..20: mol_type = other DNA
gtgcaaagagtggattttat

SEQ ID NO: 516 - DNA, 20 bp, synthetic construct
  source 1..20: mol_type = other DNA
tggccctgttttcacctggt

SEQ ID NO: 517 - DNA, 20 bp, synthetic construct
  source 1..20: mol_type = other DNA
gtttggagtttccctatgcc

SEQ ID NO: 518 - DNA, 20 bp, synthetic construct
  source 1..20: mol_type = other DNA
tgagtgcttcaaaattttgt

SEQ ID NO: 519 - DNA, 20 bp, synthetic construct
  source 1..20: mol_type = other DNA
gtagtaattcttccaggcca

SEQ ID NO: 520 - DNA, 20 bp, synthetic construct
  source 1..20: mol_type = other DNA
tgtccccataatgagtcctg

SEQ ID NO: 521 - DNA, 20 bp, synthetic construct
  source 1..20: mol_type = other DNA
gtccagtttccactgtccgg

SEQ ID NO: 522 - DNA, 20 bp, synthetic construct
  source 1..20: mol_type = other DNA
ggacagtatgttatcttggt

SEQ ID NO: 523 - DNA, 20 bp, synthetic construct
  source 1..20: mol_type = other DNA
ggctgacactaatttgggtt

SEQ ID NO: 524 - DNA, 20 bp, synthetic construct
  source 1..20: mol_type = other DNA
ccttccctagttctcctctg

SEQ ID NO: 525 - DNA, 20 bp, synthetic construct
  source 1..20: mol_type = other DNA
cttccattttttaatatttg

SEQ ID NO: 526 - DNA, 20 bp, synthetic construct
  source 1..20: mol_type = other DNA
cactgttattttattagtac

SEQ ID NO: 527 - DNA, 20 bp, synthetic construct
  source 1..20: mol_type = other DNA
ataaaagttgagtagctaga

SEQ ID NO: 528 - DNA, 20 bp, synthetic construct
  source 1..20: mol_type = other DNA
tccgcattatttttccctgc

SEQ ID NO: 529 - DNA, 20 bp, synthetic construct
  source 1..20: mol_type = other DNA
tcctacttttaagtttccag

SEQ ID NO: 530 - DNA, 20 bp, synthetic construct
  source 1..20: mol_type = other DNA
aaactaatttattagtgaaa

SEQ ID NO: 531 - DNA, 20 bp, synthetic construct
  source 1..20: mol_type = other DNA
tgtatagtagaatttttttt

SEQ ID NO: 532 - DNA, 20 bp, synthetic construct
  source 1..20: mol_type = other DNA
gtgtgtttagttgtttgggt

SEQ ID NO: 533 - DNA, 20 bp, synthetic construct
  source 1..20: mol_type = other DNA
gttgagacttaattgctcag

SEQ ID NO: 534 - DNA, 20 bp, synthetic construct
  source 1..20: mol_type = other DNA
gaatactatgtatttgccac

SEQ ID NO: 535 - DNA, 20 bp, synthetic construct
  source 1..20: mol_type = other DNA
ttttgacaagtcagtctttt

SEQ ID NO: 536 - DNA, 20 bp, synthetic construct
  source 1..20: mol_type = other DNA
gtttccttaaaatatgttgg

SEQ ID NO: 537 - DNA, 20 bp, synthetic construct
  source 1..20: mol_type = other DNA
tccattgtatatgtatctgt

SEQ ID NO: 538 - DNA, 20 bp, synthetic construct
  source 1..20: mol_type = other DNA
gttatatttaatcatgttcc

SEQ ID NO: 539 - DNA, 20 bp, synthetic construct
  source 1..20: mol_type = other DNA
gtcatatttcttagtttctg

SEQ ID NO: 540 - DNA, 20 bp, synthetic construct
  source 1..20: mol_type = other DNA
gttatgtttaaggtattttc

SEQ ID NO: 541 - DNA, 20 bp, synthetic construct
  source 1..20: mol_type = other DNA
cgtcggataaatttatccac

SEQ ID NO: 542 - DNA, 20 bp, synthetic construct
  source 1..20: mol_type = other DNA
gttttctatagtgattgcac

SEQ ID NO: 543 - DNA, 20 bp, synthetic construct
  source 1..20: mol_type = other DNA
tctttttttcttttaaccct

SEQ ID NO: 544 - DNA, 20 bp, synthetic construct
  source 1..20: mol_type = other DNA
caatcaggaactttcctgtc

SEQ ID NO: 545 - DNA, 20 bp, synthetic construct
  source 1..20: mol_type = other DNA
aggaacacaagagggaatac

SEQ ID NO: 546 - DNA, 20 bp, synthetic construct
  source 1..20: mol_type = other DNA
tctttcctaaagcttattag

SEQ ID NO: 547 - DNA, 20 bp, synthetic construct
  source 1..20: mol_type = other DNA
gttttaactcagctctctct

SEQ ID NO: 548 - DNA, 20 bp, synthetic construct
  source 1..20: mol_type = other DNA
cggctagtatttatattttt

SEQ ID NO: 549 - DNA, 20 bp, synthetic construct
  source 1..20: mol_type = other DNA
gtctacatttatagatttag

SEQ ID NO: 550 - DNA, 20 bp, synthetic construct
  source 1..20: mol_type = other DNA
gtgttacataaattaattcc

SEQ ID NO: 551 - DNA, 20 bp, synthetic construct
  source 1..20: mol_type = other DNA
gttactgttcttatcttgtg

SEQ ID NO: 552 - DNA, 20 bp, synthetic construct
  source 1..20: mol_type = other DNA
ggtgagtttctggattgtct

SEQ ID NO: 553 - DNA, 20 bp, synthetic construct
  source 1..20: mol_type = other DNA
gctttgatattttagtgtct

SEQ ID NO: 554 - DNA, 20 bp, synthetic construct
  source 1..20: mol_type = other DNA
tgagctgtattattatgcca

SEQ ID NO: 555 - DNA, 20 bp, synthetic construct
  source 1..20: mol_type = other DNA
tccagatatgagttctctct

SEQ ID NO: 556 - DNA, 20 bp, synthetic construct
  source 1..20: mol_type = other DNA
gttcagactcagatctcttc

SEQ ID NO: 557 - DNA, 20 bp, synthetic construct
  source 1..20: mol_type = other DNA
atagtctttaatttttttct

SEQ ID NO: 558 - DNA, 20 bp, synthetic construct
  source 1..20: mol_type = other DNA
gtggaagtgtttcagggttg

SEQ ID NO: 559 - DNA, 20 bp, synthetic construct
  source 1..20: mol_type = other DNA
tgttgtttaaatatgtctcc

SEQ ID NO: 560 - DNA, 20 bp, synthetic construct
  source 1..20: mol_type = other DNA
gtgtggttataagagatctg

SEQ ID NO: 561 - DNA, 20 bp, synthetic construct
  source 1..20: mol_type = other DNA
cagtgctttctccagggtgt

SEQ ID NO: 562 - DNA, 20 bp, synthetic construct
  source 1..20: mol_type = other DNA
tcctctttataccagggatc

SEQ ID NO: 563 - DNA, 20 bp, synthetic construct
  source 1..20: mol_type = other DNA
atctccataaatggtatccc

SEQ ID NO: 564 - DNA, 20 bp, synthetic construct
  source 1..20: mol_type = other DNA
ggagagagagaatatttgag

SEQ ID NO: 565 - DNA, 20 bp, synthetic construct
  source 1..20: mol_type = other DNA
tgcggtttgcttattcttgc

SEQ ID NO: 566 - DNA, 20 bp, synthetic construct
  source 1..20: mol_type = other DNA
acttgagtacattcatatgg

SEQ ID NO: 567 - DNA, 20 bp, synthetic construct
  source 1..20: mol_type = other DNA
atctagattgaagtttgtac

SEQ ID NO: 568 - DNA, 20 bp, synthetic construct
  source 1..20: mol_type = other DNA
tgaggctcttctctttgggt

SEQ ID NO: 569 - DNA, 20 bp, synthetic construct
  source 1..20: mol_type = other DNA
attgctgtacaaggatgaca

SEQ ID NO: 570 - DNA, 20 bp, synthetic construct
  source 1..20: mol_type = other DNA
gcaggctgaaatccactctt

SEQ ID NO: 571 - DNA, 20 bp, synthetic construct
  source 1..20: mol_type = other DNA
tgttctttcttcctttcaca

SEQ ID NO: 572 - DNA, 20 bp, synthetic construct
  source 1..20: mol_type = other DNA
cggtgactgtttcactgtct

SEQ ID NO: 573 - DNA, 20 bp, synthetic construct
  source 1..20: mol_type = other DNA
cggtggttgtcgctgggcag

SEQ ID NO: 574 - DNA, 20 bp, synthetic construct
  source 1..20: mol_type = other DNA
agctttcttggtggcctccc

SEQ ID NO: 575 - DNA, 20 bp, synthetic construct
  source 1..20: mol_type = other DNA
gcttccctaaatgcaggcca

SEQ ID NO: 576 - DNA, 20 bp, synthetic construct
  source 1..20: mol_type = other DNA
tcttccaccttctttagctc

SEQ ID NO: 577 - DNA, 20 bp, synthetic construct
  source 1..20: mol_type = other DNA
gtcttcaatcctctctacgg

SEQ ID NO: 578 - DNA, 20 bp, synthetic construct
  source 1..20: mol_type = other DNA
ctcggcatacctgtgtctgc

SEQ ID NO: 579 - DNA, 20 bp, synthetic construct
  source 1..20: mol_type = other DNA
gtcttctgacttctccagtt

SEQ ID NO: 580 - DNA, 20 bp, synthetic construct
  source 1..20: mol_type = other DNA
gctcctgctgtgcccttcct

SEQ ID NO: 581 - DNA, 20 bp, synthetic construct
  source 1..20: mol_type = other DNA
atacaattaaaagttgcttt

SEQ ID NO: 582 - DNA, 20 bp, synthetic construct
  source 1..20: mol_type = other DNA
acccgagttgtccatagtca

SEQ ID NO: 583 - DNA, 20 bp, synthetic construct
  source 1..20: mol_type = other DNA
ctttcaatatcttgctcttc

SEQ ID NO: 584 - DNA, 20 bp, synthetic construct
  source 1..20: mol_type = other DNA
cttttctctcagtttctctg

SEQ ID NO: 585 - DNA, 20 bp, synthetic construct
  source 1..20: mol_type = other DNA
gctcacatatataaatgtct

SEQ ID NO: 586 - DNA, 20 bp, synthetic construct
  source 1..20: mol_type = other DNA
tttttttttaatttgtgaaa

SEQ ID NO: 587 - DNA, 20 bp, synthetic construct
  source 1..20: mol_type = other DNA
gtgtgtttttctgagtccac

SEQ ID NO: 588 - DNA, 20 bp, synthetic construct
  source 1..20: mol_type = other DNA
atcttagtgttggtttagtg

SEQ ID NO: 589 - DNA, 20 bp, synthetic construct
  source 1..20: mol_type = other DNA
tgagctttaactatatagca

SEQ ID NO: 590 - DNA, 20 bp, synthetic construct
  source 1..20: mol_type = other DNA
tggctgatccttgtaagctg

SEQ ID NO: 591 - DNA, 20 bp, synthetic construct
  source 1..20: mol_type = other DNA
tgttggtttcttattaatag

SEQ ID NO: 592 - DNA, 20 bp, synthetic construct
  source 1..20: mol_type = other DNA
tcttaagttaaacattctaa

SEQ ID NO: 593 - DNA, 20 bp, synthetic construct
  source 1..20: mol_type = other DNA
ataggtttccttagtagtca

SEQ ID NO: 594 - DNA, 20 bp, synthetic construct
  source 1..20: mol_type = other DNA
tctgctggccctgttttcac

SEQ ID NO: 595 - DNA, 20 bp, synthetic construct
  source 1..20: mol_type = other DNA
tccggagtagaggtgtgcaa

SEQ ID NO: 596 - DNA, 20 bp, synthetic construct
  source 1..20: mol_type = other DNA
gtgagtgcttcaaaattttg

SEQ ID NO: 597 - DNA, 20 bp, synthetic construct
  source 1..20: mol_type = other DNA
gtatagtttaagagcctttt

SEQ ID NO: 598 - DNA, 20 bp, synthetic construct
  source 1..20: mol_type = other DNA
cattgaaatcatgtttttac

SEQ ID NO: 599 - DNA, 20 bp, synthetic construct
  source 1..20: mol_type = other DNA
cccacagctgtccagtttcc

SEQ ID NO: 600 - DNA, 20 bp, synthetic construct
  source 1..20: mol_type = other DNA
acttggtattctggaggaca

SEQ ID NO: 601 - DNA, 20 bp, synthetic construct
  source 1..20: mol_type = other DNA
gggtaatgatctgatattaa

SEQ ID NO: 602 - DNA, 20 bp, synthetic construct
  source 1..20: mol_type = other DNA
atgcacttaaaattttcttt

SEQ ID NO: 603 - DNA, 20 bp, synthetic construct
  source 1..20: mol_type = other DNA
tcttccattttttaatattt

SEQ ID NO: 604 - DNA, 20 bp, synthetic construct
  source 1..20: mol_type = other DNA
tggcactgttattttattag

SEQ ID NO: 605 - DNA, 20 bp, synthetic construct
  source 1..20: mol_type = other DNA
tgctcattaaataattgcag

SEQ ID NO: 606 - DNA, 20 bp, synthetic construct
  source 1..20: mol_type = other DNA
gtgtcactagaagatgccca

SEQ ID NO: 607 - DNA, 20 bp, synthetic construct
  source 1..20: mol_type = other DNA
gtgctcactaataatagtct

SEQ ID NO: 608 - DNA, 20 bp, synthetic construct
  source 1..20: mol_type = other DNA
tctcctctacttaagctcag

SEQ ID NO: 609 - DNA, 20 bp, synthetic construct
  source 1..20: mol_type = other DNA
gtttcctatcctgattccca

SEQ ID NO: 610 - DNA, 20 bp, synthetic construct
  source 1..20: mol_type = other DNA
gtttgtgtgtttagttgttt

SEQ ID NO: 611 - DNA, 20 bp, synthetic construct
  source 1..20: mol_type = other DNA
gtgaccactctcctcctccc

SEQ ID NO: 612 - DNA, 20 bp, synthetic construct
  source 1..20: mol_type = other DNA
aaggttttctcttaaatatt

SEQ ID NO: 613 - DNA, 20 bp, synthetic construct
  source 1..20: mol_type = other DNA
tccgaagctgctatatgtca

SEQ ID NO: 614 - DNA, 20 bp, synthetic construct
  source 1..20: mol_type = other DNA
gtgtgacactattattcttt

SEQ ID NO: 615 - DNA, 20 bp, synthetic construct
  source 1..20: mol_type = other DNA
cgacctttaaaattttttca

SEQ ID NO: 616 - DNA, 20 bp, synthetic construct
  source 1..20: mol_type = other DNA
atttgtttacttctatattg

SEQ ID NO: 617 - DNA, 20 bp, synthetic construct
  source 1..20: mol_type = other DNA
gcttctttaaatcttagctc

SEQ ID NO: 618 - DNA, 20 bp, synthetic construct
  source 1..20: mol_type = other DNA
gtttgagtccagtgacttct

SEQ ID NO: 619 - DNA, 20 bp, synthetic construct
  source 1..20: mol_type = other DNA
tcttgagtttatcttttctt

SEQ ID NO: 620 - DNA, 20 bp, synthetic construct
  source 1..20: mol_type = other DNA
ctccagtgcagggctggact

SEQ ID NO: 621 - DNA, 20 bp, synthetic construct
  source 1..20: mol_type = other DNA
gtttgggtttttctgtacaa

SEQ ID NO: 622 - DNA, 20 bp, synthetic construct
  source 1..20: mol_type = other DNA
tggtaggtatatagatgtcc

SEQ ID NO: 623 - DNA, 20 bp, synthetic construct
  source 1..20: mol_type = other DNA
atcccaataaaaacattcag

SEQ ID NO: 624 - DNA, 20 bp, synthetic construct
  source 1..20: mol_type = other DNA
tgttccatagctcatttgca

SEQ ID NO: 625 - DNA, 20 bp, synthetic construct
  source 1..20: mol_type = other DNA
tgctgtgtacttaattgaca

SEQ ID NO: 626 - DNA, 20 bp, synthetic construct
  source 1..20: mol_type = other DNA
tcttgtctagttttctgcag

SEQ ID NO: 627 - DNA, 20 bp, synthetic construct
  source 1..20: mol_type = other DNA
gtcatttttgaacatatcct

SEQ ID NO: 628 - DNA, 20 bp, synthetic construct
  source 1..20: mol_type = other DNA
gtctgtgtacctcattcttt

SEQ ID NO: 629 - DNA, 20 bp, synthetic construct
  source 1..20: mol_type = other DNA
gtgtgggtggctgtgtcctg

SEQ ID NO: 630 - DNA, 20 bp, synthetic construct
  source 1..20: mol_type = other DNA
tggtgagtttctggattgtc

SEQ ID NO: 631 - DNA, 20 bp, synthetic construct
  source 1..20: mol_type = other DNA
cttttattttctgatgcttt

SEQ ID NO: 632 - DNA, 20 bp, synthetic construct
  source 1..20: mol_type = other DNA
gtagttcattttctttctcc

SEQ ID NO: 633 - DNA, 20 bp, synthetic construct
  source 1..20: mol_type = other DNA
aagtccagatatgagttctc

SEQ ID NO: 634 - DNA, 20 bp, synthetic construct
  source 1..20: mol_type = other DNA
atgttcagactcagatctct

SEQ ID NO: 635 - DNA, 20 bp, synthetic construct
  source 1..20: mol_type = other DNA
aatagtctttaatttttttc

SEQ ID NO: 636 - DNA, 20 bp, synthetic construct
  source 1..20: mol_type = other DNA
tccttggtggaagtgtttca

SEQ ID NO: 637 - DNA, 20 bp, synthetic construct
  source 1..20: mol_type = other DNA
ctgttgtttaaatatgtctc

SEQ ID NO: 638 - DNA, 20 bp, synthetic construct
  source 1..20: mol_type = other DNA
tcctccactctttccctccc

SEQ ID NO: 639 - DNA, 20 bp, synthetic construct
  source 1..20: mol_type = other DNA
gtttgccttctgtatggaaa

SEQ ID NO: 640 - DNA, 20 bp, synthetic construct
  source 1..20: mol_type = other DNA
tggagccttgctatgttggc

SEQ ID NO: 641 - DNA, 20 bp, synthetic construct
  source 1..20: mol_type = other DNA
tggttaagacctagtttctt

SEQ ID NO: 642 - DNA, 20 bp, synthetic construct
  source 1..20: mol_type = other DNA
atttcttgagatggattctc

SEQ ID NO: 643 - DNA, 20 bp, synthetic construct
  source 1..20: mol_type = other DNA
tctaccagagttgcggtttg

SEQ ID NO: 644 - DNA, 20 bp, synthetic construct
  source 1..20: mol_type = other DNA
cttcatcttctttgtttcct

SEQ ID NO: 645 - DNA, 20 bp, synthetic construct
  source 1..20: mol_type = other DNA
cattcttttgagttgtgacc

SEQ ID NO: 646 - DNA, 20 bp, synthetic construct
  source 1..20: mol_type = other DNA
gtttgattttatgcacacac

SEQ ID NO: 647 - DNA, 20 bp, synthetic construct
  source 1..20: mol_type = other DNA
agaccaaaaaccatttgtgt

SEQ ID NO: 648 - DNA, 20 bp, synthetic construct
  source 1..20: mol_type = other DNA
actctggatgaaatcttctg

SEQ ID NO: 649 - DNA, 20 bp, synthetic construct
  source 1..20: mol_type = other DNA
gctgggttctattttggtga

SEQ ID NO: 650 - DNA, 20 bp, synthetic construct
  source 1..20: mol_type = other DNA
ttttattgtaaaatatgttg

SEQ ID NO: 651 - DNA, 20 bp, synthetic construct
  source 1..20: mol_type = other DNA
gatagtaatatatgctcatc

SEQ ID NO: 652 - DNA, 20 bp, synthetic construct
  source 1..20: mol_type = other DNA
ttggtggtcatttattgtca

SEQ ID NO: 653 - DNA, 20 bp, synthetic construct
  source 1..20: mol_type = other DNA
atcttgctcacatatataaa

SEQ ID NO: 654 - DNA, 20 bp, synthetic construct
  source 1..20: mol_type = other DNA
ctagacagccaaaatgtggg

SEQ ID NO: 655 - DNA, 20 bp, synthetic construct
  source 1..20: mol_type = other DNA
ccagtcaattcaatactcga

SEQ ID NO: 656 - DNA, 20 bp, synthetic construct
  source 1..20: mol_type = other DNA
ctccacattcactattccgt

SEQ ID NO: 657 - DNA, 20 bp, synthetic construct
  source 1..20: mol_type = other DNA
ttcttaagttaaacattcta

SEQ ID NO: 658 - DNA, 20 bp, synthetic construct
  source 1..20: mol_type = other DNA
ggagtaatccacaagatgca

SEQ ID NO: 659 - DNA, 20 bp, synthetic construct
  source 1..20: mol_type = other DNA
tcctttcacatcaccaccga

SEQ ID NO: 660 - DNA, 20 bp, synthetic construct
  source 1..20: mol_type = other DNA
atgtaaaagaaatctcagct

SEQ ID NO: 661 - DNA, 20 bp, synthetic construct
  source 1..20: mol_type = other DNA
acatgacaaatttctatata

SEQ ID NO: 662 - DNA, 20 bp, synthetic construct
  source 1..20: mol_type = other DNA
gtttttactccccccattta

SEQ ID NO: 663 - DNA, 20 bp, synthetic construct
  source 1..20: mol_type = other DNA
tgcacttaattttaatacag

SEQ ID NO: 664 - DNA, 20 bp, synthetic construct
  source 1..20: mol_type = other DNA
gggcagtattcacagaactg

SEQ ID NO: 665 - DNA, 20 bp, synthetic construct
  source 1..20: mol_type = other DNA
tcttaactattatgtatgca

SEQ ID NO: 666 - DNA, 20 bp, synthetic construct
  source 1..20: mol_type = other DNA
tcaaattttgaatcaaacat

SEQ ID NO: 667 - DNA, 20 bp, synthetic construct
  source 1..20: mol_type = other DNA
tgagtgcacatttaatcttt

SEQ ID NO: 668 - DNA, 20 bp, synthetic construct
  source 1..20: mol_type = other DNA
ttgtcatatttttatagcat

SEQ ID NO: 669 - DNA, 20 bp, synthetic construct
  source 1..20: mol_type = other DNA
tgttcattcccttagtaact

SEQ ID NO: 670 - DNA, 20 bp, synthetic construct
  source 1..20: mol_type = other DNA
ggcaagatcttttaaagtcc

SEQ ID NO: 671 - DNA, 20 bp, synthetic construct
  source 1..20: mol_type = other DNA
agactgtttctttaccacat

SEQ ID NO: 672 - DNA, 20 bp, synthetic construct
  source 1..20: mol_type = other DNA
tccaccagtatttatggagt

SEQ ID NO: 673 - DNA, 20 bp, synthetic construct
  source 1..20: mol_type = other DNA
ctttagtatttttatcatta

SEQ ID NO: 674 - DNA, 20 bp, synthetic construct
  source 1..20: mol_type = other DNA
aacagtacaatttacttgac

SEQ ID NO: 675 - DNA, 20 bp, synthetic construct
  source 1..20: mol_type = other DNA
cctttaaaaaccaacacagt

SEQ ID NO: 676 - DNA, 20 bp, synthetic construct
  source 1..20: mol_type = other DNA
tcttgtcatttttaacatcc

SEQ ID NO: 677 - DNA, 20 bp, synthetic construct
  source 1..20: mol_type = other DNA
actcaattttaaagactcgg

SEQ ID NO: 678 - DNA, 20 bp, synthetic construct
  source 1..20: mol_type = other DNA
atgtgttgaatttaaccagc

SEQ ID NO: 679 - DNA, 20 bp, synthetic construct
  source 1..20: mol_type = other DNA
ctcattaattaaatcattcg

SEQ ID NO: 680 - DNA, 20 bp, synthetic construct
  source 1..20: mol_type = other DNA
cacctaaaaatacaggaagt

SEQ ID NO: 681 - DNA, 20 bp, synthetic construct
  source 1..20: mol_type = other DNA
ccaagaatttaaaaaggaca

SEQ ID NO: 682 - DNA, 20 bp, synthetic construct
  source 1..20: mol_type = other DNA
tgtctcaaactattcccatt

SEQ ID NO: 683 - DNA, 20 bp, synthetic construct
  source 1..20: mol_type = other DNA
ttaacaatcttttagacctg

SEQ ID NO: 684 - DNA, 20 bp, synthetic construct
  source 1..20: mol_type = other DNA
gacatatttcaaaaatgcaa

SEQ ID NO: 685 - DNA, 20 bp, synthetic construct
  source 1..20: mol_type = other DNA
aacttgtttcaaagtgagag

SEQ ID NO: 686 - DNA, 20 bp, synthetic construct
  source 1..20: mol_type = other DNA
tcagggttcctcatcttaat

SEQ ID NO: 687 - DNA, 20 bp, synthetic construct
  source 1..20: mol_type = other DNA
agagagtataaaaattatct

SEQ ID NO: 688 - DNA, 20 bp, synthetic construct
  source 1..20: mol_type = other DNA
gcagcctcctatattggtcc

SEQ ID NO: 689 - DNA, 20 bp, synthetic construct
  source 1..20: mol_type = other DNA
ccagtgactcatcttggcta

SEQ ID NO: 690 - DNA, 20 bp, synthetic construct
  source 1..20: mol_type = other DNA
tggtcctttcctcacttggg

SEQ ID NO: 691 - DNA, 20 bp, synthetic construct
  source 1..20: mol_type = other DNA
catgtttattttccatgtgt

SEQ ID NO: 692 - DNA, 20 bp, synthetic construct
  source 1..20: mol_type = other DNA
acacacctagatcttcctcc

SEQ ID NO: 693 - DNA, 20 bp, synthetic construct
  source 1..20: mol_type = other DNA
cagcagtgcctaaccagttg

SEQ ID NO: 694 - DNA, 20 bp, synthetic construct
  source 1..20: mol_type = other DNA
tgccagagacccaaatccgc

SEQ ID NO: 695 - DNA, 20 bp, synthetic construct
  source 1..20: mol_type = other DNA
tcatccccaaactaaacacc

SEQ ID NO: 696 - DNA, 20 bp, synthetic construct
  source 1..20: mol_type = other DNA
gctaacctacttcctaccca

SEQ ID NO: 697 - DNA, 20 bp, synthetic construct
  source 1..20: mol_type = other DNA
catgacatcatttagcctta

SEQ ID NO: 698 - DNA, 20 bp, synthetic construct
  source 1..20: mol_type = other DNA
ggccctaataacacagagcc

SEQ ID NO: 699 - DNA, 20 bp, synthetic construct
  source 1..20: mol_type = other DNA
gcggcacaaatccagggctg

SEQ ID NO: 700 - DNA, 20 bp, synthetic construct
  source 1..20: mol_type = other DNA
gtagtataaactatggactt

SEQ ID NO: 701 - DNA, 20 bp, synthetic construct
  source 1..20: mol_type = other DNA
agggttgttcagtaaaccca

SEQ ID NO: 702 - DNA, 20 bp, synthetic construct
  source 1..20: mol_type = other DNA
gctaggtttcagtaagtatg

SEQ ID NO: 703 - DNA, 20 bp, synthetic construct
  source 1..20: mol_type = other DNA
acacgcatatttatgctgtt

SEQ ID NO: 704 - DNA, 20 bp, synthetic construct
  source 1..20: mol_type = other DNA
acctccaactcccattttgg

SEQ ID NO: 705 - DNA, 20 bp, synthetic construct
  source 1..20: mol_type = other DNA
gtaaatatatcctgtttcaa

SEQ ID NO: 706 - DNA, 20 bp, synthetic construct
  source 1..20: mol_type = other DNA
tcaccttgtcagatgctgag

SEQ ID NO: 707 - DNA, 20 bp, synthetic construct
  source 1..20: mol_type = other DNA
ggtgagcaaccattccagac

SEQ ID NO: 708 - DNA, 20 bp, synthetic construct
  source 1..20: mol_type = other DNA
ctcggtcaccacatgcaagc

SEQ ID NO: 709 - DNA, 20 bp, synthetic construct
  source 1..20: mol_type = other DNA
gacctaaaacacaccagacc

SEQ ID NO: 710 - DNA, 20 bp, synthetic construct
  source 1..20: mol_type = other DNA
atagcttcaaaatattgtta

SEQ ID NO: 711 - DNA, 20 bp, synthetic construct
  source 1..20: mol_type = other DNA
atctttattttataattagg

SEQ ID NO: 712 - DNA, 20 bp, synthetic construct
  source 1..20: mol_type = other DNA
gatgccacgaccagatatca

SEQ ID NO: 713 - DNA, 20 bp, synthetic construct
  source 1..20: mol_type = other DNA
accaaactccaaatctccaa

SEQ ID NO: 714 - DNA, 20 bp, synthetic construct
  source 1..20: mol_type = other DNA
tcaaccttcttgaaccctca

SEQ ID NO: 715 - DNA, 20 bp, synthetic construct
  source 1..20: mol_type = other DNA
tcattatttccgcatctcaa

SEQ ID NO: 716 - DNA, 20 bp, synthetic construct
  source 1..20: mol_type = other DNA
ccggacacctacccatggag

SEQ ID NO: 717 - DNA, 20 bp, synthetic construct
  source 1..20: mol_type = other DNA
cactgtattctaagtaggag

SEQ ID NO: 718 - DNA, 20 bp, synthetic construct
  source 1..20: mol_type = other DNA
gcctcctgacctctaccctt

SEQ ID NO: 719 - DNA, 20 bp, synthetic construct
  source 1..20: mol_type = other DNA
agtagatttccacagattgt

SEQ ID NO: 720 - DNA, 20 bp, synthetic construct
  source 1..20: mol_type = other DNA
agcctctagaacaaaataca

SEQ ID NO: 721 - DNA, 20 bp, synthetic construct
  source 1..20: mol_type = other DNA
agcttgagaattttgatagg

SEQ ID NO: 722 - DNA, 20 bp, synthetic construct
  source 1..20: mol_type = other DNA
gaaccacaagccaacaggcc

SEQ ID NO: 723 - DNA, 20 bp, synthetic construct
  source 1..20: mol_type = other DNA
actgtgagttccaagaagca

SEQ ID NO: 724 - DNA, 20 bp, synthetic construct
  source 1..20: mol_type = other DNA
tgggtacaatccgccaacag

SEQ ID NO: 725 - DNA, 20 bp, synthetic construct
  source 1..20: mol_type = other DNA
tgtcttcaatcctctctacg

SEQ ID NO: 726 - DNA, 20 bp, synthetic construct
  source 1..20: mol_type = other DNA
aggaagagtcaaaggtggtt

SEQ ID NO: 727 - DNA, 20 bp, synthetic construct
  source 1..20: mol_type = other DNA
gttgcttttattgtaaaata

SEQ ID NO: 728 - DNA, 20 bp, synthetic construct
  source 1..20: mol_type = other DNA
aagatagtaatatatgctca

SEQ ID NO: 729 - DNA, 20 bp, synthetic construct
  source 1..20: mol_type = other DNA
catcaaagtgaaaagtgcct

SEQ ID NO: 730 - DNA, 20 bp, synthetic construct
  source 1..20: mol_type = other DNA
ccattctgaaaataacatta

SEQ ID NO: 731 - DNA, 20 bp, synthetic construct
  source 1..20: mol_type = other DNA
ggtgaaccctaaatgtaaat

SEQ ID NO: 732 - DNA, 20 bp, synthetic construct
  source 1..20: mol_type = other DNA
tccagtcaattcaatactcg

SEQ ID NO: 733 - DNA, 20 bp, synthetic construct
  source 1..20: mol_type = other DNA
acactccacattcactattc

SEQ ID NO: 734 - DNA, 20 bp, synthetic construct
  source 1..20: mol_type = other DNA
actgaaataattcttaagtt

SEQ ID NO: 735 - DNA, 20 bp, synthetic construct
  source 1..20: mol_type = other DNA
agcattatattgcaatctat

SEQ ID NO: 736 - DNA, 20 bp, synthetic construct
  source 1..20: mol_type = other DNA
tctcctttcacatcaccacc

SEQ ID NO: 737 - DNA, 20 bp, synthetic construct
  source 1..20: mol_type = other DNA
gaggtcatctatgtaaaaga

SEQ ID NO: 738 - DNA, 20 bp, synthetic construct
  source 1..20: mol_type = other DNA
gacatgacaaatttctatat

SEQ ID NO: 739 - DNA, 20 bp, synthetic construct
  source 1..20: mol_type = other DNA
atcatgtttttactcccccc

SEQ ID NO: 740 - DNA, 20 bp, synthetic construct
  source 1..20: mol_type = other DNA
cctattggccaaatgcactt

SEQ ID NO: 741 - DNA, 20 bp, synthetic construct
  source 1..20: mol_type = other DNA
tcttgaaacctcctttcggc

SEQ ID NO: 742 - DNA, 20 bp, synthetic construct
  source 1..20: mol_type = other DNA
ctcttaactattatgtatgc

SEQ ID NO: 743 - DNA, 20 bp, synthetic construct
  source 1..20: mol_type = other DNA
gttcaaattttgaatcaaac

SEQ ID NO: 744 - DNA, 20 bp, synthetic construct
  source 1..20: mol_type = other DNA
cccaaatttcaaaggtcctt

SEQ ID NO: 745 - DNA, 20 bp, synthetic construct
  source 1..20: mol_type = other DNA
gtggtcaaagaatctgtttc

SEQ ID NO: 746 - DNA, 20 bp, synthetic construct
  source 1..20: mol_type = other DNA
tagaaactaatttattagtg

SEQ ID NO: 747 - DNA, 20 bp, synthetic construct
  source 1..20: mol_type = other DNA
acacagattatttatagtca

SEQ ID NO: 748 - DNA, 20 bp, synthetic construct
  source 1..20: mol_type = other DNA
cactttctagattattctta

SEQ ID NO: 749 - DNA, 20 bp, synthetic construct
  source 1..20: mol_type = other DNA
actctctacctttaagattt

SEQ ID NO: 750 - DNA, 20 bp, synthetic construct
  source 1..20: mol_type = other DNA
catctatttatttaccttct

SEQ ID NO: 751 - DNA, 20 bp, synthetic construct
  source 1..20: mol_type = other DNA
gaacttaaaattccctagga

SEQ ID NO: 752 - DNA, 20 bp, synthetic construct
  source 1..20: mol_type = other DNA
tcttttaacctttaaaaacc

SEQ ID NO: 753 - DNA, 20 bp, synthetic construct
  source 1..20: mol_type = other DNA
acctgctttcaaaagtcaaa

SEQ ID NO: 754 - DNA, 20 bp, synthetic construct
  source 1..20: mol_type = other DNA
caagtaatacaaatccacag

SEQ ID NO: 755 - DNA, 20 bp, synthetic construct
  source 1..20: mol_type = other DNA
caggacttattttatatatg

SEQ ID NO: 756 - DNA, 20 bp, synthetic construct
  source 1..20: mol_type = other DNA
cttcccaaatacatcatcga

SEQ ID NO: 757 - DNA, 20 bp, synthetic construct
  source 1..20: mol_type = other DNA
catttaaaaactgtacatgg

SEQ ID NO: 758 - DNA, 20 bp, synthetic construct
  source 1..20: mol_type = other DNA
atctaaatttaaactgcaca

SEQ ID NO: 759 - DNA, 20 bp, synthetic construct
  source 1..20: mol_type = other DNA
tggtcaataatttatatggc

SEQ ID NO: 760 - DNA, 20 bp, synthetic construct
  source 1..20: mol_type = other DNA
aactattatatttatagatt

SEQ ID NO: 761 - DNA, 20 bp, synthetic construct
  source 1..20: mol_type = other DNA
agctgtaaaatatatccctg

SEQ ID NO: 762 - DNA, 20 bp, synthetic construct
  source 1..20: mol_type = other DNA
aaccttacttaaatatctca

SEQ ID NO: 763 - DNA, 20 bp, synthetic construct
  source 1..20: mol_type = other DNA
atcagggttcctcatcttaa

SEQ ID NO: 764 - DNA, 20 bp, synthetic construct
  source 1..20: mol_type = other DNA
gtgccctttcctcttgggat

SEQ ID NO: 765 - DNA, 20 bp, synthetic construct
  source 1..20: mol_type = other DNA
cccagcagcctcctatattg

SEQ ID NO: 766 - DNA, 20 bp, synthetic construct
  source 1..20: mol_type = other DNA
acttccagtgactcatcttg

SEQ ID NO: 767 - DNA, 20 bp, synthetic construct
  source 1..20: mol_type = other DNA
atttggtcctttcctcactt

SEQ ID NO: 768 - DNA, 20 bp, synthetic construct
  source 1..20: mol_type = other DNA
ctcatgtttattttccatgt

SEQ ID NO: 769 - DNA, 20 bp, synthetic construct
  source 1..20: mol_type = other DNA
agggaaaaacacacctagat

SEQ ID NO: 770 - DNA, 20 bp, synthetic construct
  source 1..20: mol_type = other DNA
gtcagcagtgcctaaccagt

SEQ ID NO: 771 - DNA, 20 bp, synthetic construct
  source 1..20: mol_type = other DNA
acagaaaaacaaaactcatt

SEQ ID NO: 772 - DNA, 20 bp, synthetic construct
  source 1..20: mol_type = other DNA
ccttaaaaatcatccccaaa

SEQ ID NO: 773 - DNA, 20 bp, synthetic construct
  source 1..20: mol_type = other DNA
cagctaacctacttcctacc

SEQ ID NO: 774 - DNA, 20 bp, synthetic construct
  source 1..20: mol_type = other DNA
tcagaaatacagattgatat

SEQ ID NO: 775 - DNA, 20 bp, synthetic construct
  source 1..20: mol_type = other DNA
acggccctaataacacagag

SEQ ID NO: 776 - DNA, 20 bp, synthetic construct
  source 1..20: mol_type = other DNA
actgcggcacaaatccaggg

SEQ ID NO: 777 - DNA, 20 bp, synthetic construct
  source 1..20: mol_type = other DNA
tgtagtataaactatggact

SEQ ID NO: 778 - DNA, 20 bp, synthetic construct
  source 1..20: mol_type = other DNA
gaagtgtttcagggttgttc

SEQ ID NO: 779 - DNA, 20 bp, synthetic construct
  source 1..20: mol_type = other DNA
agctaggtttcagtaagtat

SEQ ID NO: 780 - DNA, 20 bp, synthetic construct
  source 1..20: mol_type = other DNA
tacacgcatatttatgctgt

SEQ ID NO: 781 - DNA, 20 bp, synthetic construct
  source 1..20: mol_type = other DNA
aactgtcacctccaactccc

SEQ ID NO: 782 - DNA, 20 bp, synthetic construct
  source 1..20: mol_type = other DNA
ccagtaaatatatcctgttt

SEQ ID NO: 783 - DNA, 20 bp, synthetic construct
  source 1..20: mol_type = other DNA
catagccacctcaccttgtc

SEQ ID NO: 784 - DNA, 20 bp, synthetic construct
  source 1..20: mol_type = other DNA
gcaacagaccagtagcagtc

SEQ ID NO: 785 - DNA, 20 bp, synthetic construct
  source 1..20: mol_type = other DNA
tacctccaccacctttgtcc

SEQ ID NO: 786 - DNA, 20 bp, synthetic construct
  source 1..20: mol_type = other DNA
gtgacctaaaacacaccaga

SEQ ID NO: 787 - DNA, 20 bp, synthetic construct
  source 1..20: mol_type = other DNA
gatagcttcaaaatattgtt

SEQ ID NO: 788 - DNA, 20 bp, synthetic construct
  source 1..20: mol_type = other DNA
gcaaatctatctttatttta

SEQ ID NO: 789 - DNA, 20 bp, synthetic construct
  source 1..20: mol_type = other DNA
cctgcgaaaagatgccacga

SEQ ID NO: 790 - DNA, 20 bp, synthetic construct
  source 1..20: mol_type = other DNA
aagttcagttacagaggtgc

SEQ ID NO: 791 - DNA, 20 bp, synthetic construct
  source 1..20: mol_type = other DNA
gttctcaaccttcttgaacc

SEQ ID NO: 792 - DNA, 20 bp, synthetic construct
  source 1..20: mol_type = other DNA
ctttcattatttccgcatct

SEQ ID NO: 793 - DNA, 20 bp, synthetic construct
  source 1..20: mol_type = other DNA
gccggacacctacccatgga

SEQ ID NO: 794 - DNA, 20 bp, synthetic construct
  source 1..20: mol_type = other DNA
cccactgtattctaagtagg

SEQ ID NO: 795 - DNA, 20 bp, synthetic construct
  source 1..20: mol_type = other DNA
tttttctgtgcctcctgacc

SEQ ID NO: 796 - DNA, 20 bp, synthetic construct
  source 1..20: mol_type = other DNA
aagtaccaaaaaaactttaa

SEQ ID NO: 797 - DNA, 20 bp, synthetic construct
  source 1..20: mol_type = other DNA
agcctctagaacaggctggg

SEQ ID NO: 798 - DNA, 20 bp, synthetic construct
  source 1..20: mol_type = other DNA
acagcttgagaattttgata

SEQ ID NO: 799 - DNA, 20 bp, synthetic construct
  source 1..20: mol_type = other DNA
acagtgaaccacaagccaac

SEQ ID NO: 800 - DNA, 20 bp, synthetic construct
  source 1..20: mol_type = other DNA
acaggactaaacatggatca

SEQ ID NO: 801 - DNA, 20 bp, synthetic construct
  source 1..20: mol_type = other DNA
atccaggctcttcatgagga

SEQ ID NO: 802 - DNA, 20 bp, synthetic construct
  source 1..20: mol_type = other DNA
tatggctgtcttcaatcctc

SEQ ID NO: 803 - DNA, 20 bp, synthetic construct
  source 1..20: mol_type = other DNA
caaatcttaacctcctgagg

SEQ ID NO: 804 - DNA, 20 bp, synthetic construct
  source 1..20: mol_type = other DNA
tatacaattaaaagttgctt

SEQ ID NO: 805 - DNA, 20 bp, synthetic construct
  source 1..20: mol_type = other DNA
cagtatttttaaatgcttaa

SEQ ID NO: 806 - DNA, 20 bp, synthetic construct
  source 1..20: mol_type = other DNA
actgattctcagacatcaaa

SEQ ID NO: 807 - DNA, 20 bp, synthetic construct
  source 1..20: mol_type = other DNA
gccattctgaaaataacatt

SEQ ID NO: 808 - DNA, 20 bp, synthetic construct
  source 1..20: mol_type = other DNA
ctggtgaaccctaaatgtaa

SEQ ID NO: 809 - DNA, 20 bp, synthetic construct
  source 1..20: mol_type = other DNA
atccagtcaattcaatactc

SEQ ID NO: 810 - DNA, 20 bp, synthetic construct
  source 1..20: mol_type = other DNA
ccacactccacattcactat

SEQ ID NO: 811 - DNA, 20 bp, synthetic construct
  source 1..20: mol_type = other DNA
cccctctgccccagtgtggc

SEQ ID NO: 812 - DNA, 20 bp, synthetic construct
  source 1..20: mol_type = other DNA
tgcagcattatattgcaatc

SEQ ID NO: 813 - DNA, 20 bp, synthetic construct
  source 1..20: mol_type = other DNA
ctctcctttcacatcaccac

SEQ ID NO: 814 - DNA, 20 bp, synthetic construct
  source 1..20: mol_type = other DNA
tcctatcatcagtaaggtaa

SEQ ID NO: 815 - DNA, 20 bp, synthetic construct
  source 1..20: mol_type = other DNA
aatctgatcatttagacatg

SEQ ID NO: 816 - DNA, 20 bp, synthetic construct
  source 1..20: mol_type = other DNA
aatcatgtttttactccccc

SEQ ID NO: 817 - DNA, 20 bp, synthetic construct
  source 1..20: mol_type = other DNA
atagatactacctattggcc

SEQ ID NO: 818 - DNA, 20 bp, synthetic construct
  source 1..20: mol_type = other DNA
atcttgaaacctcctttcgg

SEQ ID NO: 819 - DNA, 20 bp, synthetic construct
  source 1..20: mol_type = other DNA
agctcttaactattatgtat

SEQ ID NO: 820 - DNA, 20 bp, synthetic construct
  source 1..20: mol_type = other DNA
gtatacagacaatttattta

SEQ ID NO: 821 - DNA, 20 bp, synthetic construct
  source 1..20: mol_type = other DNA
acatggtatttttatcagtc

SEQ ID NO: 822 - DNA, 20 bp, synthetic construct
  source 1..20: mol_type = other DNA
cctaacaaaatttcccttca

SEQ ID NO: 823 - DNA, 20 bp, synthetic construct
  source 1..20: mol_type = other DNA
gtgaattttccttaaatttc

SEQ ID NO: 824 - DNA, 20 bp, synthetic construct
  source 1..20: mol_type = other DNA
tgcaaattctaaaaattact

SEQ ID NO: 825 - DNA, 20 bp, synthetic construct
  source 1..20: mol_type = other DNA
ttcttgtttcaaagtgagga

SEQ ID NO: 826 - DNA, 20 bp, synthetic construct
  source 1..20: mol_type = other DNA
gacctcatccattataatat

SEQ ID NO: 827 - DNA, 20 bp, synthetic construct
  source 1..20: mol_type = other DNA
ccaaccaaccaaaaactcac

SEQ ID NO: 828 - DNA, 20 bp, synthetic construct
  source 1..20: mol_type = other DNA
catagttatatttaatcatg

SEQ ID NO: 829 - DNA, 20 bp, synthetic construct
  source 1..20: mol_type = other DNA
atgcctcacctttaaatagt

SEQ ID NO: 830 - DNA, 20 bp, synthetic construct
  source 1..20: mol_type = other DNA
gacaagtttatttatttttc

SEQ ID NO: 831 - DNA, 20 bp, synthetic construct
  source 1..20: mol_type = other DNA
aactgatttcaaagtcagac

SEQ ID NO: 832 - DNA, 20 bp, synthetic construct
  source 1..20: mol_type = other DNA
actgaaactttttaacatac

SEQ ID NO: 833 - DNA, 20 bp, synthetic construct
  source 1..20: mol_type = other DNA
cagcaaatacaaacaggacc

SEQ ID NO: 834 - DNA, 20 bp, synthetic construct
  source 1..20: mol_type = other DNA
acacagttacaaatcaatgc

SEQ ID NO: 835 - DNA, 20 bp, synthetic construct
  source 1..20: mol_type = other DNA
tggatctaaatttaaactgc

SEQ ID NO: 836 - DNA, 20 bp, synthetic construct
  source 1..20: mol_type = other DNA
atgctcaaacctcattcatt

SEQ ID NO: 837 - DNA, 20 bp, synthetic construct
  source 1..20: mol_type = other DNA
tactccttattttaaatata

SEQ ID NO: 838 - DNA, 20 bp, synthetic construct
  source 1..20: mol_type = other DNA
aaggttctattttatatgcc

SEQ ID NO: 839 - DNA, 20 bp, synthetic construct
  source 1..20: mol_type = other DNA
agtgttagagaatacttttc

SEQ ID NO: 840 - DNA, 20 bp, synthetic construct
  source 1..20: mol_type = other DNA
aatcagggttcctcatctta

SEQ ID NO: 841 - DNA, 20 bp, synthetic construct
  source 1..20: mol_type = other DNA
tgccccccactttacggtgt

SEQ ID NO: 842 - DNA, 20 bp, synthetic construct
  source 1..20: mol_type = other DNA
cagtccagagcccactcccc

SEQ ID NO: 843 - DNA, 20 bp, synthetic construct
  source 1..20: mol_type = other DNA
aaccatacttccagtgactc

SEQ ID NO: 844 - DNA, 20 bp, synthetic construct
  source 1..20: mol_type = other DNA
ccagtcattcacgagtggtt

SEQ ID NO: 845 - DNA, 20 bp, synthetic construct
  source 1..20: mol_type = other DNA
tgactcttcactcatgttta

SEQ ID NO: 846 - DNA, 20 bp, synthetic construct
  source 1..20: mol_type = other DNA
gtagggaaaaacacacctag

SEQ ID NO: 847 - DNA, 20 bp, synthetic construct
  source 1..20: mol_type = other DNA
catttctgaatttctctgtg

SEQ ID NO: 848 - DNA, 20 bp, synthetic construct
  source 1..20: mol_type = other DNA
ccacagaaaaacaaaactca

SEQ ID NO: 849 - DNA, 20 bp, synthetic construct
  source 1..20: mol_type = other DNA
cccttaaaaatcatccccaa

SEQ ID NO: 850 - DNA, 20 bp, synthetic construct
  source 1..20: mol_type = other DNA
gcagctaacctacttcctac

SEQ ID NO: 851 - DNA, 20 bp, synthetic construct
  source 1..20: mol_type = other DNA
tactcagaaatacagattga

SEQ ID NO: 852 - DNA, 20 bp, synthetic construct
  source 1..20: mol_type = other DNA
acagacggccctaataacac

SEQ ID NO: 853 - DNA, 20 bp, synthetic construct
  source 1..20: mol_type = other DNA
tgtattaccaacaactgcgg

SEQ ID NO: 854 - DNA, 20 bp, synthetic construct
  source 1..20: mol_type = other DNA
acagagtgaactgtagtata

SEQ ID NO: 855 - DNA, 20 bp, synthetic construct
  source 1..20: mol_type = other DNA
agcctgactcagtccttggt

SEQ ID NO: 856 - DNA, 20 bp, synthetic construct
  source 1..20: mol_type = other DNA
gaattctctcataagctagg

SEQ ID NO: 857 - DNA, 20 bp, synthetic construct
  source 1..20: mol_type = other DNA
atgcacatacacgcatattt

SEQ ID NO: 858 - DNA, 20 bp, synthetic construct
  source 1..20: mol_type = other DNA
ccatccccctaaatcgactc

SEQ ID NO: 859 - DNA, 20 bp, synthetic construct
  source 1..20: mol_type = other DNA
atccagtaaatatatcctgt

SEQ ID NO: 860 - DNA, 20 bp, synthetic construct
  source 1..20: mol_type = other DNA
ggcagctttctcagcggagc

SEQ ID NO: 861 - DNA, 20 bp, synthetic construct
  source 1..20: mol_type = other DNA
atccccaacccccaggcaac

SEQ ID NO: 862 - DNA, 20 bp, synthetic construct
  source 1..20: mol_type = other DNA
actacctccaccacctttgt

SEQ ID NO: 863 - DNA, 20 bp, synthetic construct
  source 1..20: mol_type = other DNA
aagtgacctaaaacacacca

SEQ ID NO: 864 - DNA, 20 bp, synthetic construct
  source 1..20: mol_type = other DNA
tgatagcttcaaaatattgt

SEQ ID NO: 865 - DNA, 20 bp, synthetic construct
  source 1..20: mol_type = other DNA
tagcaaatctatctttattt

SEQ ID NO: 866 - DNA, 20 bp, synthetic construct
  source 1..20: mol_type = other DNA
aggagctgtgtcaccctgcg

SEQ ID NO: 867 - DNA, 20 bp, synthetic construct
  source 1..20: mol_type = other DNA
cagccaaacctaagttcagt

SEQ ID NO: 868 - DNA, 20 bp, synthetic construct
  source 1..20: mol_type = other DNA
agttctcaaccttcttgaac

SEQ ID NO: 869 - DNA, 20 bp, synthetic construct
  source 1..20: mol_type = other DNA
aaagcctttcattatttccg

SEQ ID NO: 870 - DNA, 20 bp, synthetic construct
  source 1..20: mol_type = other DNA
ccggataactccctgtctcc

SEQ ID NO: 871 - DNA, 20 bp, synthetic construct
  source 1..20: mol_type = other DNA
acccactgtattctaagtag

SEQ ID NO: 872 - DNA, 20 bp, synthetic construct
  source 1..20: mol_type = other DNA
aacccattttcttttttctg

SEQ ID NO: 873 - DNA, 20 bp, synthetic construct
  source 1..20: mol_type = other DNA
gattttatacacattcagac

SEQ ID NO: 874 - DNA, 20 bp, synthetic construct
  source 1..20: mol_type = other DNA
catcttgtaaactaaacagg

SEQ ID NO: 875 - DNA, 20 bp, synthetic construct
  source 1..20: mol_type = other DNA
gcttacaataattaagaaga

SEQ ID NO: 876 - DNA, 20 bp, synthetic construct
  source 1..20: mol_type = other DNA
agacagtgaaccacaagcca

SEQ ID NO: 877 - DNA, 20 bp, synthetic construct
  source 1..20: mol_type = other DNA
ggacaggactaaacatggat

SEQ ID NO: 878 - DNA, 20 bp, synthetic construct
  source 1..20: mol_type = other DNA
agtctgataaacggaaagtc

SEQ ID NO: 879 - DNA, 20 bp, synthetic construct
  source 1..20: mol_type = other DNA
tatcacggccacgcccgggc

SEQ ID NO: 880 - DNA, 20 bp, synthetic construct
  source 1..20: mol_type = other DNA
atgcaaatcttaacctcctg

SEQ ID NO: 881 - DNA, 20 bp, synthetic construct
  source 1..20: mol_type = other DNA
ctatacaattaaaagttgct

SEQ ID NO: 882 - DNA, 20 bp, synthetic construct
  source 1..20: mol_type = other DNA
acagtatttttaaatgctta

SEQ ID NO: 883 - DNA, 20 bp, synthetic construct
  source 1..20: mol_type = other DNA
aactgattctcagacatcaa

SEQ ID NO: 884 - DNA, 20 bp, synthetic construct
  source 1..20: mol_type = other DNA
gatttgattttgaatagaaa

SEQ ID NO: 885 - DNA, 20 bp, synthetic construct
  source 1..20: mol_type = other DNA
cctggtgaaccctaaatgta

SEQ ID NO: 886 - DNA, 20 bp, synthetic construct
  source 1..20: mol_type = other DNA
tagtggatccagtcaattca

SEQ ID NO: 887 - DNA, 20 bp, synthetic construct
  source 1..20: mol_type = other DNA
tctccacactccacattcac

SEQ ID NO: 888 - DNA, 20 bp, synthetic construct
  source 1..20: mol_type = other DNA
cactttaaaagatctgaggt

SEQ ID NO: 889 - DNA, 20 bp, synthetic construct
  source 1..20: mol_type = other DNA
gctactgttcatcttgaaca

SEQ ID NO: 890 - DNA, 20 bp, synthetic construct
  source 1..20: mol_type = other DNA
agtgtaattctctcctttca

SEQ ID NO: 891 - DNA, 20 bp, synthetic construct
  source 1..20: mol_type = other DNA
aagaaaagatcctatcatca

SEQ ID NO: 892 - DNA, 20 bp, synthetic construct
  source 1..20: mol_type = other DNA
atacaaatctgatcatttag

SEQ ID NO: 893 - DNA, 20 bp, synthetic construct
  source 1..20: mol_type = other DNA
aaatcatgtttttactcccc

SEQ ID NO: 894 - DNA, 20 bp, synthetic construct
  source 1..20: mol_type = other DNA
gtatagatactacctattgg

SEQ ID NO: 895 - DNA, 20 bp, synthetic construct
  source 1..20: mol_type = other DNA
ccacaaatactgacaggact

SEQ ID NO: 896 - DNA, 20 bp, synthetic construct
  source 1..20: mol_type = other DNA
aagctcttaactattatgta

SEQ ID NO: 897 - DNA, 20 bp, synthetic construct
  source 1..20: mol_type = other DNA
tggtatacagacaatttatt

SEQ ID NO: 898 - DNA, 20 bp, synthetic construct
  source 1..20: mol_type = other DNA
aactttaaaaccaaagagcc

SEQ ID NO: 899 - DNA, 20 bp, synthetic construct
  source 1..20: mol_type = other DNA
tgtacaataatatatttctt

SEQ ID NO: 900 - DNA, 20 bp, synthetic construct
  source 1..20: mol_type = other DNA
gcagaaattcattaaaaagg

SEQ ID NO: 901 - DNA, 20 bp, synthetic construct
  source 1..20: mol_type = other DNA
tactggtatatttatttgtt

SEQ ID NO: 902 - DNA, 20 bp, synthetic construct
  source 1..20: mol_type = other DNA
cttgagtttcattatctcct

SEQ ID NO: 903 - DNA, 20 bp, synthetic construct
  source 1..20: mol_type = other DNA
catacattcccttaagccaa

SEQ ID NO: 904 - DNA, 20 bp, synthetic construct
  source 1..20: mol_type = other DNA
agtattatttaaaactacat

SEQ ID NO: 905 - DNA, 20 bp, synthetic construct
  source 1..20: mol_type = other DNA
ccatggtttcaaagctctgt

SEQ ID NO: 906 - DNA, 20 bp, synthetic construct
  source 1..20: mol_type = other DNA
agctataaaatataaacttc

SEQ ID NO: 907 - DNA, 20 bp, synthetic construct
  source 1..20: mol_type = other DNA
agcttttgaatttattatga

SEQ ID NO: 908 - DNA, 20 bp, synthetic construct
  source 1..20: mol_type = other DNA
cagagactattttaaagacg

SEQ ID NO: 909 - DNA, 20 bp, synthetic construct
  source 1..20: mol_type = other DNA
ctcttattttaaactggtgc

SEQ ID NO: 910 - DNA, 20 bp, synthetic construct
  source 1..20: mol_type = other DNA
ttactgattatttaaccctg

SEQ ID NO: 911 - DNA, 20 bp, synthetic construct
  source 1..20: mol_type = other DNA
agttcattttaaactgtatt

SEQ ID NO: 912 - DNA, 20 bp, synthetic construct
  source 1..20: mol_type = other DNA
tgtattattttctaacagaa

SEQ ID NO: 913 - DNA, 20 bp, synthetic construct
  source 1..20: mol_type = other DNA
aagtatacaatttaaggatc

SEQ ID NO: 914 - DNA, 20 bp, synthetic construct
  source 1..20: mol_type = other DNA
attagatttccttactgcaa

SEQ ID NO: 915 - DNA, 20 bp, synthetic construct
  source 1..20: mol_type = other DNA
cctctcaaaaccacttttat

SEQ ID NO: 916 - DNA, 20 bp, synthetic construct
  source 1..20: mol_type = other DNA
ccctcaattcaaagacaaat

SEQ ID NO: 917 - DNA, 20 bp, synthetic construct
  source 1..20: mol_type = other DNA
tttcctaatcagggttcctc

SEQ ID NO: 918 - DNA, 20 bp, synthetic construct
  source 1..20: mol_type = other DNA
gtgccccccactttacggtg

SEQ ID NO: 919 - DNA, 20 bp, synthetic construct
  source 1..20: mol_type = other DNA
cctgactttcatatgcaaac

SEQ ID NO: 920 - DNA, 20 bp, synthetic construct
  source 1..20: mol_type = other DNA
ttaaccatacttccagtgac

SEQ ID NO: 921 - DNA, 20 bp, synthetic construct
  source 1..20: mol_type = other DNA
ccccatatccagtcattcac

SEQ ID NO: 922 - DNA, 20 bp, synthetic construct
  source 1..20: mol_type = other DNA
gcaatgactcttcactcatg

SEQ ID NO: 923 - DNA, 20 bp, synthetic construct
  source 1..20: mol_type = other DNA
gagtagggaaaaacacacct

SEQ ID NO: 924 - DNA, 20 bp, synthetic construct
  source 1..20: mol_type = other DNA
aagctcaacaatttgcacat

SEQ ID NO: 925 - DNA, 20 bp, synthetic construct
  source 1..20: mol_type = other DNA
acgaacacaaaaacccacag

SEQ ID NO: 926 - DNA, 20 bp, synthetic construct
  source 1..20: mol_type = other DNA
ccccttaaaaatcatcccca

SEQ ID NO: 927 - DNA, 20 bp, synthetic construct
  source 1..20: mol_type = other DNA
agcagctaacctacttccta

SEQ ID NO: 928 - DNA, 20 bp, synthetic construct
  source 1..20: mol_type = other DNA
tcatactcagaaatacagat

SEQ ID NO: 929 - DNA, 20 bp, synthetic construct
  source 1..20: mol_type = other DNA
ttaagcagccaccgagtcag

SEQ ID NO: 930 - DNA, 20 bp, synthetic construct
  source 1..20: mol_type = other DNA
gtgtattaccaacaactgcg

SEQ ID NO: 931 - DNA, 20 bp, synthetic construct
  source 1..20: mol_type = other DNA
ttcatcaaaaacagcatgta

SEQ ID NO: 932 - DNA, 20 bp, synthetic construct
  source 1..20: mol_type = other DNA
cacgcaaagcctgactcagt

SEQ ID NO: 933 - DNA, 20 bp, synthetic construct
  source 1..20: mol_type = other DNA
tgaattctctcataagctag

SEQ ID NO: 934 - DNA, 20 bp, synthetic construct
  source 1..20: mol_type = other DNA
actatgcacatacacgcata

SEQ ID NO: 935 - DNA, 20 bp, synthetic construct
  source 1..20: mol_type = other DNA
atccatccccctaaatcgac

SEQ ID NO: 936 - DNA, 20 bp, synthetic construct
  source 1..20: mol_type = other DNA
catccagtaaatatatcctg

SEQ ID NO: 937 - DNA, 20 bp, synthetic construct
  source 1..20: mol_type = other DNA
ctttaccgcctaacaggcag

SEQ ID NO: 938 - DNA, 20 bp, synthetic construct
  source 1..20: mol_type = other DNA
gatccccaacccccaggcaa

SEQ ID NO: 939 - DNA, 20 bp, synthetic construct
  source 1..20: mol_type = other DNA
ttttactacctccaccacct

SEQ ID NO: 940 - DNA, 20 bp, synthetic construct
  source 1..20: mol_type = other DNA
actcaaacttaaagtgacct

SEQ ID NO: 941 - DNA, 20 bp, synthetic construct
  source 1..20: mol_type = other DNA
tgggtattctctatgatgct

SEQ ID NO: 942 - DNA, 20 bp, synthetic construct
  source 1..20: mol_type = other DNA
tcatagcaaatctatcttta

SEQ ID NO: 943 - DNA, 20 bp, synthetic construct
  source 1..20: mol_type = other DNA
gcttcctaccaaaggagctg

SEQ ID NO: 944 - DNA, 20 bp, synthetic construct
  source 1..20: mol_type = other DNA
gcagccaaacctaagttcag

SEQ ID NO: 945 - DNA, 20 bp, synthetic construct
  source 1..20: mol_type = other DNA
aagaagttctcaaccttctt

SEQ ID NO: 946 - DNA, 20 bp, synthetic construct
  source 1..20: mol_type = other DNA
gaaagcctttcattatttcc

SEQ ID NO: 947 - DNA, 20 bp, synthetic construct
  source 1..20: mol_type = other DNA
tagttccaaacatgtcagcc

SEQ ID NO: 948 - DNA, 20 bp, synthetic construct
  source 1..20: mol_type = other DNA
gacaaatatacttacaagtg

SEQ ID NO: 949 - DNA, 20 bp, synthetic construct
  source 1..20: mol_type = other DNA
cccccaaacccattttcttt

SEQ ID NO: 950 - DNA, 20 bp, synthetic construct
  source 1..20: mol_type = other DNA
ttggattttatacacattca

SEQ ID NO: 951 - DNA, 20 bp, synthetic construct
  source 1..20: mol_type = other DNA
gctataaatcaaagacatct

SEQ ID NO: 952 - DNA, 20 bp, synthetic construct
  source 1..20: mol_type = other DNA
tgcttacaataattaagaag

SEQ ID NO: 953 - DNA, 20 bp, synthetic construct
  source 1..20: mol_type = other DNA
ttgtgaccccaaagcactgt

SEQ ID NO: 954 - DNA, 20 bp, synthetic construct
  source 1..20: mol_type = other DNA
gctattatcatacaggacag

SEQ ID NO: 955 - DNA, 20 bp, synthetic construct
  source 1..20: mol_type = other DNA
gattttagtctgataaacgg

SEQ ID NO: 956 - DNA, 20 bp, synthetic construct
  source 1..20: mol_type = other DNA
cgacggcgaactgtatcacg

SEQ ID NO: 957 - DNA, 20 bp, synthetic construct
  source 1..20: mol_type = other DNA
tagaccggccttcaatgcaa

SEQ ID NO: 958 - DNA, 20 bp, synthetic construct
  source 1..20: mol_type = other DNA
atctatacaattaaaagttg

SEQ ID NO: 959 - DNA, 20 bp, synthetic construct
  source 1..20: mol_type = other DNA
gaacagtatttttaaatgct

SEQ ID NO: 960 - DNA, 20 bp, synthetic construct
  source 1..20: mol_type = other DNA
gaactgattctcagacatca

SEQ ID NO: 961 - DNA, 20 bp, synthetic construct
  source 1..20: mol_type = other DNA
accaaacattaaatctcgat

SEQ ID NO: 962 - DNA, 20 bp, synthetic construct
  source 1..20: mol_type = other DNA
gtttataaaaatcattagtc

SEQ ID NO: 963 - DNA, 20 bp, synthetic construct
  source 1..20: mol_type = other DNA
gctccaaaccatgtgtgttt

SEQ ID NO: 964 - DNA, 20 bp, synthetic construct
  source 1..20: mol_type = other DNA
gcctccttcctctccacact

SEQ ID NO: 965 - DNA, 20 bp, synthetic construct
  source 1..20: mol_type = other DNA
ttccactttaaaagatctga

SEQ ID NO: 966 - DNA, 20 bp, synthetic construct
  source 1..20: mol_type = other DNA
ggattttatgattactagga

SEQ ID NO: 967 - DNA, 20 bp, synthetic construct
  source 1..20: mol_type = other DNA
ggcctccacgccacttaaaa

SEQ ID NO: 968 - DNA, 20 bp, synthetic construct
  source 1..20: mol_type = other DNA
tgctacaagaaaagatccta

SEQ ID NO: 969 - DNA, 20 bp, synthetic construct
  source 1..20: mol_type = other DNA
ataaccatacaaatctgatc

SEQ ID NO: 970 - DNA, 20 bp, synthetic construct
  source 1..20: mol_type = other DNA
ttacattgaaatcatgtttt

SEQ ID NO: 971 - DNA, 20 bp, synthetic construct
  source 1..20: mol_type = other DNA
tgtatagatactacctattg

SEQ ID NO: 972 - DNA, 20 bp, synthetic construct
  source 1..20: mol_type = other DNA
ggtcaccacaaatactgaca

SEQ ID NO: 973 - DNA, 20 bp, synthetic construct
  source 1..20: mol_type = other DNA
tgtcacaataaaagctctta

SEQ ID NO: 974 - DNA, 20 bp, synthetic construct
  source 1..20: mol_type = other DNA
actggtatacagacaattta

SEQ ID NO: 975 - DNA, 20 bp, synthetic construct
  source 1..20: mol_type = other DNA
cccagcaaagccatccagtg

SEQ ID NO: 976 - DNA, 20 bp, synthetic construct
  source 1..20: mol_type = other DNA
ttgattacaatttaaattca

SEQ ID NO: 977 - DNA, 20 bp, synthetic construct
  source 1..20: mol_type = other DNA
aagggaatattttactttat

SEQ ID NO: 978 - DNA, 20 bp, synthetic construct
  source 1..20: mol_type = other DNA
ctattattattttactggca

SEQ ID NO: 979 - DNA, 20 bp, synthetic construct
  source 1..20: mol_type = other DNA
ttttatagccactaaccaac

SEQ ID NO: 980 - DNA, 20 bp, synthetic construct
  source 1..20: mol_type = other DNA
aacatatttcattataattc

SEQ ID NO: 981 - DNA, 20 bp, synthetic construct
  source 1..20: mol_type = other DNA
acccagcatttttaacatta

SEQ ID NO: 982 - DNA, 20 bp, synthetic construct
  source 1..20: mol_type = other DNA
ctttcatttatttagtgaaa

SEQ ID NO: 983 - DNA, 20 bp, synthetic construct
  source 1..20: mol_type = other DNA
ttccttactttttaggatac

SEQ ID NO: 984 - DNA, 20 bp, synthetic construct
  source 1..20: mol_type = other DNA
gatttattttaaagtactct

SEQ ID NO: 985 - DNA, 20 bp, synthetic construct
  source 1..20: mol_type = other DNA
gattccaaaaccagacttgt

SEQ ID NO: 986 - DNA, 20 bp, synthetic construct
  source 1..20: mol_type = other DNA
ccatatatagattacaaagc

SEQ ID NO: 987 - DNA, 20 bp, synthetic construct
  source 1..20: mol_type = other DNA
tcttttaaccctaagactgt

SEQ ID NO: 988 - DNA, 20 bp, synthetic construct
  source 1..20: mol_type = other DNA
tgacagtatttttaaagact

SEQ ID NO: 989 - DNA, 20 bp, synthetic construct
  source 1..20: mol_type = other DNA
actggcaaacccaaaagcta

SEQ ID NO: 990 - DNA, 20 bp, synthetic construct
  source 1..20: mol_type = other DNA
actgttaaaacccatccaac

SEQ ID NO: 991 - DNA, 20 bp, synthetic construct
  source 1..20: mol_type = other DNA
atgcagttctaaaagaaagc

SEQ ID NO: 992 - DNA, 20 bp, synthetic construct
  source 1..20: mol_type = other DNA
aggcccaaacctctaatcaa

SEQ ID NO: 993 - DNA, 20 bp, synthetic construct
  source 1..20: mol_type = other DNA
aagattcaaatatatcttaa

SEQ ID NO: 994 - DNA, 20 bp, synthetic construct
  source 1..20: mol_type = other DNA
ggacctgaagtccagcagcg

SEQ ID NO: 995 - DNA, 20 bp, synthetic construct
  source 1..20: mol_type = other DNA
actccctccacctcctgacc

SEQ ID NO: 996 - DNA, 20 bp, synthetic construct
  source 1..20: mol_type = other DNA
gcctgactttcatatgcaaa

SEQ ID NO: 997 - DNA, 20 bp, synthetic construct
  source 1..20: mol_type = other DNA
gcctgtggaaattaagagcg

SEQ ID NO: 998 - DNA, 20 bp, synthetic construct
  source 1..20: mol_type = other DNA
tgcaagcccccatatccagt

SEQ ID NO: 999 - DNA, 20 bp, synthetic construct
  source 1..20: mol_type = other DNA
ttaaggattctaagtaccat

SEQ ID NO: 1000 - DNA, 20 bp, synthetic construct
  source 1..20: mol_type = other DNA
tcattaattttgcaaagttt

SEQ ID NO: 1001 - DNA, 20 bp, synthetic construct
  source 1..20: mol_type = other DNA
ttttgcttattaagctcaac

SEQ ID NO: 1002 - DNA, 20 bp, synthetic construct
  source 1..20: mol_type = other DNA
aacgaacacaaaaacccaca

SEQ ID NO: 1003 - DNA, 20 bp, synthetic construct
  source 1..20: mol_type = other DNA
agccccttaaaaatcatccc

SEQ ID NO: 1004 - DNA, 20 bp, synthetic construct
  source 1..20: mol_type = other DNA
aagcagctaacctacttcct

SEQ ID NO: 1005 - DNA, 20 bp, synthetic construct
  source 1..20: mol_type = other DNA
gttcatactcagaaatacag

SEQ ID NO: 1006 - DNA, 20 bp, synthetic construct
  source 1..20: mol_type = other DNA
cactgaatattaagcagcca

SEQ ID NO: 1007 - DNA, 20 bp, synthetic construct
  source 1..20: mol_type = other DNA
tgtgtattaccaacaactgc

SEQ ID NO: 1008 - DNA, 20 bp, synthetic construct
  source 1..20: mol_type = other DNA
acatgacatcataaattcat

SEQ ID NO: 1009 - DNA, 20 bp, synthetic construct
  source 1..20: mol_type = other DNA
aatcatgttcacgcaaagcc

SEQ ID NO: 1010 - DNA, 20 bp, synthetic construct
  source 1..20: mol_type = other DNA
aatgaattctctcataagct

SEQ ID NO: 1011 - DNA, 20 bp, synthetic construct
  source 1..20: mol_type = other DNA
ctatatctaaacactatgca

SEQ ID NO: 1012 - DNA, 20 bp, synthetic construct
  source 1..20: mol_type = other DNA
catccatccccctaaatcga

SEQ ID NO: 1013 - DNA, 20 bp, synthetic construct
  source 1..20: mol_type = other DNA
tcatccagtaaatatatcct

SEQ ID NO: 1014 - DNA, 20 bp, synthetic construct
  source 1..20: mol_type = other DNA
gctttaccgcctaacaggca

SEQ ID NO: 1015 - DNA, 20 bp, synthetic construct
  source 1..20: mol_type = other DNA
cctctttataccagggatcc

SEQ ID NO: 1016 - DNA, 20 bp, synthetic construct
  source 1..20: mol_type = other DNA
tttttactacctccaccacc

SEQ ID NO: 1017 - DNA, 20 bp, synthetic construct
  source 1..20: mol_type = other DNA
gcaactcaaacttaaagtga

SEQ ID NO: 1018 - DNA, 20 bp, synthetic construct
  source 1..20: mol_type = other DNA
atgggtattctctatgatgc

SEQ ID NO: 1019 - DNA, 20 bp, synthetic construct
  source 1..20: mol_type = other DNA
attcatagcaaatctatctt

SEQ ID NO: 1020 - DNA, 20 bp, synthetic construct
  source 1..20: mol_type = other DNA
tgcttcctaccaaaggagct

SEQ ID NO: 1021 - DNA, 20 bp, synthetic construct
  source 1..20: mol_type = other DNA
agcagccaaacctaagttca

SEQ ID NO: 1022 - DNA, 20 bp, synthetic construct
  source 1..20: mol_type = other DNA
accctctattaaaaatacta

SEQ ID NO: 1023 - DNA, 20 bp, synthetic construct
  source 1..20: mol_type = other DNA
tttgaaagcctttcattatt

SEQ ID NO: 1024 - DNA, 20 bp, synthetic construct
  source 1..20: mol_type = other DNA
ccttagttccaaacatgtca

SEQ ID NO: 1025 - DNA, 20 bp, synthetic construct
  source 1..20: mol_type = other DNA
acatagacaaatatacttac

SEQ ID NO: 1026 - DNA, 20 bp, synthetic construct
  source 1..20: mol_type = other DNA
gcccccaaacccattttctt

SEQ ID NO: 1027 - DNA, 20 bp, synthetic construct
  source 1..20: mol_type = other DNA
atgcaccaccaccaccacgc

SEQ ID NO: 1028 - DNA, 20 bp, synthetic construct
  source 1..20: mol_type = other DNA
tgctataaatcaaagacatc

SEQ ID NO: 1029 - DNA, 20 bp, synthetic construct
  source 1..20: mol_type = other DNA
ttacaaagactatgcttaca

SEQ ID NO: 1030 - DNA, 20 bp, synthetic construct
  source 1..20: mol_type = other DNA
agttgtgaccccaaagcact

SEQ ID NO: 1031 - DNA, 20 bp, synthetic construct
  source 1..20: mol_type = other DNA
tgctattatcatacaggaca

SEQ ID NO: 1032 - DNA, 20 bp, synthetic construct
  source 1..20: mol_type = other DNA
tggctctgattttagtctga

SEQ ID NO: 1033 - DNA, 20 bp, synthetic construct
  source 1..20: mol_type = other DNA
tactctaccaaaacttcaac

SEQ ID NO: 1034 - DNA, 20 bp, synthetic construct
  source 1..20: mol_type = other DNA
ttagaccggccttcaatgca

SEQ ID NO: 1035 - DNA, 20 bp, synthetic construct
  source 1..20: mol_type = other DNA
gcagaaatgaaatcccgcat

SEQ ID NO: 1036 - DNA, 20 bp, synthetic construct
  source 1..20: mol_type = other DNA
tgagatacagtacttgttga

SEQ ID NO: 1037 - DNA, 20 bp, synthetic construct
  source 1..20: mol_type = other DNA
ttctccatcccttttctctc

SEQ ID NO: 1038 - DNA, 20 bp, synthetic construct
  source 1..20: mol_type = other DNA
gtaccaaacattaaatctcg

SEQ ID NO: 1039 - DNA, 20 bp, synthetic construct
  source 1..20: mol_type = other DNA
cggtttataaaaatcattag

SEQ ID NO: 1040 - DNA, 20 bp, synthetic construct
  source 1..20: mol_type = other DNA
tgctccaaaccatgtgtgtt

SEQ ID NO: 1041 - DNA, 20 bp, synthetic construct
  source 1..20: mol_type = other DNA
tgaatctgcctccttcctct

SEQ ID NO: 1042 - DNA, 20 bp, synthetic construct
  source 1..20: mol_type = other DNA
tttccactttaaaagatctg

SEQ ID NO: 1043 - DNA, 20 bp, synthetic construct
  source 1..20: mol_type = other DNA
agtggattttatgattacta

SEQ ID NO: 1044 - DNA, 20 bp, synthetic construct
  source 1..20: mol_type = other DNA
ggttaaaaacaaatgtggaa

SEQ ID NO: 1045 - DNA, 20 bp, synthetic construct
  source 1..20: mol_type = other DNA
gcttctcaaatcaggtgtac

SEQ ID NO: 1046 - DNA, 20 bp, synthetic construct
  source 1..20: mol_type = other DNA
ggccataaccatacaaatct

SEQ ID NO: 1047 - DNA, 20 bp, synthetic construct
  source 1..20: mol_type = other DNA
ggcctctttatattaaataa

SEQ ID NO: 1048 - DNA, 20 bp, synthetic construct
  source 1..20: mol_type = other DNA
tcagataagaaaagttatgg

SEQ ID NO: 1049 - DNA, 20 bp, synthetic construct
  source 1..20: mol_type = other DNA
aggtcaccacaaatactgac

SEQ ID NO: 1050 - DNA, 20 bp, synthetic construct
  source 1..20: mol_type = other DNA
ttctcctgtcacaataaaag

SEQ ID NO: 1051 - DNA, 20 bp, synthetic construct
  source 1..20: mol_type = other DNA
gtactggtatacagacaatt

SEQ ID NO: 1052 - DNA, 20 bp, synthetic construct
  source 1..20: mol_type = other DNA
gtcctcaaaacctatggagc

SEQ ID NO: 1053 - DNA, 20 bp, synthetic construct
  source 1..20: mol_type = other DNA
tggcttaaccagggagatgt

SEQ ID NO: 1054 - DNA, 20 bp, synthetic construct
  source 1..20: mol_type = other DNA
actgataatttttagacata

SEQ ID NO: 1055 - DNA, 20 bp, synthetic construct
  source 1..20: mol_type = other DNA
acctcaatcatttactctct

SEQ ID NO: 1056 - DNA, 20 bp, synthetic construct
  source 1..20: mol_type = other DNA
actcctaaaatttattgagg

SEQ ID NO: 1057 - DNA, 20 bp, synthetic construct
  source 1..20: mol_type = other DNA
ccctgaatagtctatgccat

SEQ ID NO: 1058 - DNA, 20 bp, synthetic construct
  source 1..20: mol_type = other DNA
ttccttaaaatatgttggca

SEQ ID NO: 1059 - DNA, 20 bp, synthetic construct
  source 1..20: mol_type = other DNA
ggaaacaaccaaaaactgct

SEQ ID NO: 1060 - DNA, 20 bp, synthetic construct
  source 1..20: mol_type = other DNA
tgacacaatatttactgtgt

SEQ ID NO: 1061 - DNA, 20 bp, synthetic construct
  source 1..20: mol_type = other DNA
tctcagtttcaaaataggac

SEQ ID NO: 1062 - DNA, 20 bp, synthetic construct
  source 1..20: mol_type = other DNA
cctcaaaaagaatctgcaga

SEQ ID NO: 1063 - DNA, 20 bp, synthetic construct
  source 1..20: mol_type = other DNA
tcggttactatttacctttc

SEQ ID NO: 1064 - DNA, 20 bp, synthetic construct
  source 1..20: mol_type = other DNA
ggaccctaaatttaaacagc

SEQ ID NO: 1065 - DNA, 20 bp, synthetic construct
  source 1..20: mol_type = other DNA
tggaaatttcaaaaagctaa

SEQ ID NO: 1066 - DNA, 20 bp, synthetic construct
  source 1..20: mol_type = other DNA
aacaacaaataattacctat

SEQ ID NO: 1067 - DNA, 20 bp, synthetic construct
  source 1..20: mol_type = other DNA
aaggaaaatcaaacattgct

SEQ ID NO: 1068 - DNA, 20 bp, synthetic construct
  source 1..20: mol_type = other DNA
aggtctagtatttatcttct

SEQ ID NO: 1069 - DNA, 20 bp, synthetic construct
  source 1..20: mol_type = other DNA
gaaacattattttacttttc

SEQ ID NO: 1070 - DNA, 20 bp, synthetic construct
  source 1..20: mol_type = other DNA
tcctaaaaatacatcttaaa

SEQ ID NO: 1071 - DNA, 20 bp, synthetic construct
  source 1..20: mol_type = other DNA
ctggtaagaaaaagtgccga

SEQ ID NO: 1072 - DNA, 20 bp, synthetic construct
  source 1..20: mol_type = other DNA
gccacatttcccctcactcc

SEQ ID NO: 1073 - DNA, 20 bp, synthetic construct
  source 1..20: mol_type = other DNA
agcctgactttcatatgcaa

SEQ ID NO: 1074 - DNA, 20 bp, synthetic construct
  source 1..20: mol_type = other DNA
gtaatcgatctaagaacctg

SEQ ID NO: 1075 - DNA, 20 bp, synthetic construct
  source 1..20: mol_type = other DNA
tttgtgcaagcccccatatc

SEQ ID NO: 1076 - DNA, 20 bp, synthetic construct
  source 1..20: mol_type = other DNA
tgttcacaaaaatgtgttaa

SEQ ID NO: 1077 - DNA, 20 bp, synthetic construct
  source 1..20: mol_type = other DNA
catttaatcattaattttgc

SEQ ID NO: 1078 - DNA, 20 bp, synthetic construct
  source 1..20: mol_type = other DNA
attttgcttattaagctcaa

SEQ ID NO: 1079 - DNA, 20 bp, synthetic construct
  source 1..20: mol_type = other DNA
ccaatgatcccatcactgca

SEQ ID NO: 1080 - DNA, 20 bp, synthetic construct
  source 1..20: mol_type = other DNA
cagccccttaaaaatcatcc

SEQ ID NO: 1081 - DNA, 20 bp, synthetic construct
  source 1..20: mol_type = other DNA
tgccagttcctgcattttcc

SEQ ID NO: 1082 - DNA, 20 bp, synthetic construct
  source 1..20: mol_type = other DNA
cagttcatactcagaaatac

SEQ ID NO: 1083 - DNA, 20 bp, synthetic construct
  source 1..20: mol_type = other DNA
gcactgaatattaagcagcc

SEQ ID NO: 1084 - DNA, 20 bp, synthetic construct
  source 1..20: mol_type = other DNA
gtgtgtattaccaacaactg

SEQ ID NO: 1085 - DNA, 20 bp, synthetic construct
  source 1..20: mol_type = other DNA
tacatgacatcataaattca

SEQ ID NO: 1086 - DNA, 20 bp, synthetic construct
  source 1..20: mol_type = other DNA
acactgaatcatgttcacgc

SEQ ID NO: 1087 - DNA, 20 bp, synthetic construct
  source 1..20: mol_type = other DNA
gagcaatgaattctctcata

SEQ ID NO: 1088 - DNA, 20 bp, synthetic construct
  source 1..20: mol_type = other DNA
tactatatctaaacactatg

SEQ ID NO: 1089 - DNA, 20 bp, synthetic construct
  source 1..20: mol_type = other DNA
tcctccatccatccccctaa

SEQ ID NO: 1090 - DNA, 20 bp, synthetic construct
  source 1..20: mol_type = other DNA
cccattttttcatccagtaa

SEQ ID NO: 1091 - DNA, 20 bp, synthetic construct
  source 1..20: mol_type = other DNA
ggctttaccgcctaacaggc

SEQ ID NO: 1092 - DNA, 20 bp, synthetic construct
  source 1..20: mol_type = other DNA
ctcctctttataccagggat

SEQ ID NO: 1093 - DNA, 20 bp, synthetic construct
  source 1..20: mol_type = other DNA
ttttttactacctccaccac

SEQ ID NO: 1094 - DNA, 20 bp, synthetic construct
  source 1..20: mol_type = other DNA
tgggcaactcaaacttaaag

SEQ ID NO: 1095 - DNA, 20 bp, synthetic construct
  source 1..20: mol_type = other DNA
aatttaaaacccatatgggt

SEQ ID NO: 1096 - DNA, 20 bp, synthetic construct
  source 1..20: mol_type = other DNA
cacacatctcaaataggtac

SEQ ID NO: 1097 - DNA, 20 bp, synthetic construct
  source 1..20: mol_type = other DNA
gcctaaattctgcctttgct

SEQ ID NO: 1098 - DNA, 20 bp, synthetic construct
  source 1..20: mol_type = other DNA
gtgagcagccaaacctaagt

SEQ ID NO: 1099 - DNA, 20 bp, synthetic construct
  source 1..20: mol_type = other DNA
aaccctctattaaaaatact

SEQ ID NO: 1100 - DNA, 20 bp, synthetic construct
  source 1..20: mol_type = other DNA
ctaaagacttcataatgtta

SEQ ID NO: 1101 - DNA, 20 bp, synthetic construct
  source 1..20: mol_type = other DNA
agccttagttccaaacatgt

SEQ ID NO: 1102 - DNA, 20 bp, synthetic construct
  source 1..20: mol_type = other DNA
gtgcatatatacatagacaa

SEQ ID NO: 1103 - DNA, 20 bp, synthetic construct
  source 1..20: mol_type = other DNA
ggcccccaaacccattttct

SEQ ID NO: 1104 - DNA, 20 bp, synthetic construct
  source 1..20: mol_type = other DNA
aatatttaaaatattgttgg

SEQ ID NO: 1105 - DNA, 20 bp, synthetic construct
  source 1..20: mol_type = other DNA
ctgctataaatcaaagacat

SEQ ID NO: 1106 - DNA, 20 bp, synthetic construct
  source 1..20: mol_type = other DNA
tagactttacaaagactatg

SEQ ID NO: 1107 - DNA, 20 bp, synthetic construct
  source 1..20: mol_type = other DNA
ctggtgagccccattctttt

SEQ ID NO: 1108 - DNA, 20 bp, synthetic construct
  source 1..20: mol_type = other DNA
ctgctattatcatacaggac

SEQ ID NO: 1109 - DNA, 20 bp, synthetic construct
  source 1..20: mol_type = other DNA
gttggatttcatttttcgcc

SEQ ID NO: 1110 - DNA, 20 bp, synthetic construct
  source 1..20: mol_type = other DNA
atactctaccaaaacttcaa

SEQ ID NO: 1111 - DNA, 20 bp, synthetic construct
  source 1..20: mol_type = other DNA
ccacgctgcctctacttgcc

SEQ ID NO: 1112 - DNA, 20 bp, synthetic construct
  source 1..20: mol_type = other DNA
agcagaaatgaaatcccgca

SEQ ID NO: 1113 - DNA, 20 bp, synthetic construct
  source 1..20: mol_type = other DNA
agtgagatacagtacttgtt

SEQ ID NO: 1114 - DNA, 20 bp, synthetic construct
  source 1..20: mol_type = other DNA
actggacaaaaatgagtatt

SEQ ID NO: 1115 - DNA, 20 bp, synthetic construct
  source 1..20: mol_type = other DNA
tgtaccaaacattaaatctc

SEQ ID NO: 1116 - DNA, 20 bp, synthetic construct
  source 1..20: mol_type = other DNA
acggtttataaaaatcatta

SEQ ID NO: 1117 - DNA, 20 bp, synthetic construct
  source 1..20: mol_type = other DNA
ttgctccaaaccatgtgtgt

SEQ ID NO: 1118 - DNA, 20 bp, synthetic construct
  source 1..20: mol_type = other DNA
ccacacttcccgtccaggct

SEQ ID NO: 1119 - DNA, 20 bp, synthetic construct
  source 1..20: mol_type = other DNA
ccaacatagaaaattatcct

SEQ ID NO: 1120 - DNA, 20 bp, synthetic construct
  source 1..20: mol_type = other DNA
aagagtggattttatgatta

SEQ ID NO: 1121 - DNA, 20 bp, synthetic construct
  source 1..20: mol_type = other DNA
gggttaaaaacaaatgtgga

SEQ ID NO: 1122 - DNA, 20 bp, synthetic construct
  source 1..20: mol_type = other DNA
agcttctcaaatcaggtgta

SEQ ID NO: 1123 - DNA, 20 bp, synthetic construct
  source 1..20: mol_type = other DNA
cttccaggccataaccatac

SEQ ID NO: 1124 - DNA, 20 bp, synthetic construct
  source 1..20: mol_type = other DNA
ctggcctctttatattaaat

SEQ ID NO: 1125 - DNA, 20 bp, synthetic construct
  source 1..20: mol_type = other DNA
gagtcctttcagataagaaa

SEQ ID NO: 1126 - DNA, 20 bp, synthetic construct
  source 1..20: mol_type = other DNA
ctctggagccaggactccac

SEQ ID NO: 1127 - DNA, 20 bp, synthetic construct
  source 1..20: mol_type = other DNA
catatggaaaaaagttctcc

SEQ ID NO: 1128 - DNA, 20 bp, synthetic construct
  source 1..20: mol_type = other DNA
tgtactggtatacagacaat

SEQ ID NO: 1129 - DNA, 20 bp, synthetic construct
  source 1..20: mol_type = other DNA
ccaataaaagccacaacttg

SEQ ID NO: 1130 - DNA, 20 bp, synthetic construct
  source 1..20: mol_type = other DNA
aaggtgtatatttatatgtt

SEQ ID NO: 1131 - DNA, 20 bp, synthetic construct
  source 1..20: mol_type = other DNA
gctcaaattcaaaagatgaa

SEQ ID NO: 1132 - DNA, 20 bp, synthetic construct
  source 1..20: mol_type = other DNA
tcagtaaaacctcaatcatt

SEQ ID NO: 1133 - DNA, 20 bp, synthetic construct
  source 1..20: mol_type = other DNA
tggaatattctttattttgg

SEQ ID NO: 1134 - DNA, 20 bp, synthetic construct
  source 1..20: mol_type = other DNA
ttactctttcaaatgcaaaa

SEQ ID NO: 1135 - DNA, 20 bp, synthetic construct
  source 1..20: mol_type = other DNA
aggttctatatttagaacac

SEQ ID NO: 1136 - DNA, 20 bp, synthetic construct
  source 1..20: mol_type = other DNA
ctcacaattcaaaagttgtg

SEQ ID NO: 1137 - DNA, 20 bp, synthetic construct
  source 1..20: mol_type = other DNA
ttagtcaaacatatcaacct

SEQ ID NO: 1138 - DNA, 20 bp, synthetic construct
  source 1..20: mol_type = other DNA
ggctgcaaactattcaagta

SEQ ID NO: 1139 - DNA, 20 bp, synthetic construct
  source 1..20: mol_type = other DNA
tcattattagattaccaaga

SEQ ID NO: 1140 - DNA, 20 bp, synthetic construct
  source 1..20: mol_type = other DNA
cagtaatttcaaaagggcca

SEQ ID NO: 1141 - DNA, 20 bp, synthetic construct
  source 1..20: mol_type = other DNA
tggatgctattttatgtaga

SEQ ID NO: 1142 - DNA, 20 bp, synthetic construct
  source 1..20: mol_type = other DNA
gaccacaaaacccaacttac

SEQ ID NO: 1143 - DNA, 20 bp, synthetic construct
  source 1..20: mol_type = other DNA
tcaacaaatcaaatactgat

SEQ ID NO: 1144 - DNA, 20 bp, synthetic construct
  source 1..20: mol_type = other DNA
tgctgcatattttatattta

SEQ ID NO: 1145 - DNA, 20 bp, synthetic construct
  source 1..20: mol_type = other DNA
agtgtattagattaggtcta

SEQ ID NO: 1146 - DNA, 20 bp, synthetic construct
  source 1..20: mol_type = other DNA
ctccttaaaccccattttat

SEQ ID NO: 1147 - DNA, 20 bp, synthetic construct
  source 1..20: mol_type = other DNA
ctcctaaaaatacatcttaa

SEQ ID NO: 1148 - DNA, 20 bp, synthetic construct
  source 1..20: mol_type = other DNA
cctggtaagaaaaagtgccg

SEQ ID NO: 1149 - DNA, 20 bp, synthetic construct
  source 1..20: mol_type = other DNA
gtttgccacatttcccctca

SEQ ID NO: 1150 - DNA, 20 bp, synthetic construct
  source 1..20: mol_type = other DNA
cagagctaattcctaggagc

SEQ ID NO: 1151 - DNA, 20 bp, synthetic construct
  source 1..20: mol_type = other DNA
gcatgtaatcgatctaagaa

SEQ ID NO: 1152 - DNA, 20 bp, synthetic construct
  source 1..20: mol_type = other DNA
ttcagggctaaaagctctcg

SEQ ID NO: 1153 - DNA, 20 bp, synthetic construct
  source 1..20: mol_type = other DNA
ctgttcacaaaaatgtgtta

SEQ ID NO: 1154 - DNA, 20 bp, synthetic construct
  source 1..20: mol_type = other DNA
tcatttaatcattaattttg

SEQ ID NO: 1155 - DNA, 20 bp, synthetic construct
  source 1..20: mol_type = other DNA
gattttgcttattaagctca

SEQ ID NO: 1156 - DNA, 20 bp, synthetic construct
  source 1..20: mol_type = other DNA
gtgagccaatgatcccatca

SEQ ID NO: 1157 - DNA, 20 bp, synthetic construct
  source 1..20: mol_type = other DNA
tcagccccttaaaaatcatc

SEQ ID NO: 1158 - DNA, 20 bp, synthetic construct
  source 1..20: mol_type = other DNA
ggatatgttcagactcagat

SEQ ID NO: 1159 - DNA, 20 bp, synthetic construct
  source 1..20: mol_type = other DNA
ccagttcatactcagaaata

SEQ ID NO: 1160 - DNA, 20 bp, synthetic construct
  source 1..20: mol_type = other DNA
tggcactgaatattaagcag

SEQ ID NO: 1161 - DNA, 20 bp, synthetic construct
  source 1..20: mol_type = other DNA
agtgtgtattaccaacaact

SEQ ID NO: 1162 - DNA, 20 bp, synthetic construct
  source 1..20: mol_type = other DNA
ctgtataataatgtaatgct

SEQ ID NO: 1163 - DNA, 20 bp, synthetic construct
  source 1..20: mol_type = other DNA
tctatttaaaacactgaatc

SEQ ID NO: 1164 - DNA, 20 bp, synthetic construct
  source 1..20: mol_type = other DNA
gggagcaatgaattctctca

SEQ ID NO: 1165 - DNA, 20 bp, synthetic construct
  source 1..20: mol_type = other DNA
ctactatatctaaacactat

SEQ ID NO: 1166 - DNA, 20 bp, synthetic construct
  source 1..20: mol_type = other DNA
ttcctccatccatcccccta

SEQ ID NO: 1167 - DNA, 20 bp, synthetic construct
  source 1..20: mol_type = other DNA
agcccattttttcatccagt

SEQ ID NO: 1168 - DNA, 20 bp, synthetic construct
  source 1..20: mol_type = other DNA
tgtggctttaccgcctaaca

SEQ ID NO: 1169 - DNA, 20 bp, synthetic construct
  source 1..20: mol_type = other DNA
tctcctctttataccaggga

SEQ ID NO: 1170 - DNA, 20 bp, synthetic construct
  source 1..20: mol_type = other DNA
tatttttttactacctccac

SEQ ID NO: 1171 - DNA, 20 bp, synthetic construct
  source 1..20: mol_type = other DNA
agtgaccacactatccgatg

SEQ ID NO: 1172 - DNA, 20 bp, synthetic construct
  source 1..20: mol_type = other DNA
cttgaatttaaaacccatat

SEQ ID NO: 1173 - DNA, 20 bp, synthetic construct
  source 1..20: mol_type = other DNA
tgcacacatctcaaataggt

SEQ ID NO: 1174 - DNA, 20 bp, synthetic construct
  source 1..20: mol_type = other DNA
tttgcctaaattctgccttt

SEQ ID NO: 1175 - DNA, 20 bp, synthetic construct
  source 1..20: mol_type = other DNA
ctcaccaacctcatctctcg

SEQ ID NO: 1176 - DNA, 20 bp, synthetic construct
  source 1..20: mol_type = other DNA
acaactaactatatattgtt

SEQ ID NO: 1177 - DNA, 20 bp, synthetic construct
  source 1..20: mol_type = other DNA
gtttccctctaaagacttca

SEQ ID NO: 1178 - DNA, 20 bp, synthetic construct
  source 1..20: mol_type = other DNA
gaccagaagccttagttcca

SEQ ID NO: 1179 - DNA, 20 bp, synthetic construct
  source 1..20: mol_type = other DNA
acacagaaacatatatgtgc

SEQ ID NO: 1180 - DNA, 20 bp, synthetic construct
  source 1..20: mol_type = other DNA
attggcccccaaacccattt

SEQ ID NO: 1181 - DNA, 20 bp, synthetic construct
  source 1..20: mol_type = other DNA
tctgaatgaatattggctat

SEQ ID NO: 1182 - DNA, 20 bp, synthetic construct
  source 1..20: mol_type = other DNA
gatgagaattaaactgctat

SEQ ID NO: 1183 - DNA, 20 bp, synthetic construct
  source 1..20: mol_type = other DNA
gagtcatacatatagacttt

SEQ ID NO: 1184 - DNA, 20 bp, synthetic construct
  source 1..20: mol_type = other DNA
tcaggatacaccaagggagg

SEQ ID NO: 1185 - DNA, 20 bp, synthetic construct
  source 1..20: mol_type = other DNA
aactgctattatcatacagg

SEQ ID NO: 1186 - DNA, 20 bp, synthetic construct
  source 1..20: mol_type = other DNA
cccggccaccagggttgccc

SEQ ID NO: 1187 - DNA, 20 bp, synthetic construct
  source 1..20: mol_type = other DNA
gatactctaccaaaacttca

SEQ ID NO: 1188 - DNA, 20 bp, synthetic construct
  source 1..20: mol_type = other DNA
cccacgctgcctctacttgc

SEQ ID NO: 1189 - DNA, 20 bp, synthetic construct
  source 1..20: mol_type = other DNA
gcactagtaaaaagcagaaa

SEQ ID NO: 1190 - DNA, 20 bp, synthetic construct
  source 1..20: mol_type = other DNA
gtttaaagtgagatacagta

SEQ ID NO: 1191 - DNA, 20 bp, synthetic construct
  source 1..20: mol_type = other DNA
aggttctttaaaagttcatc

SEQ ID NO: 1192 - DNA, 20 bp, synthetic construct
  source 1..20: mol_type = other DNA
ggtttgtaccaaacattaaa

SEQ ID NO: 1193 - DNA, 20 bp, synthetic construct
  source 1..20: mol_type = other DNA
tacaccccagaaaacggttt

SEQ ID NO: 1194 - DNA, 20 bp, synthetic construct
  source 1..20: mol_type = other DNA
ctattgctccaaaccatgtg

SEQ ID NO: 1195 - DNA, 20 bp, synthetic construct
  source 1..20: mol_type = other DNA
actggccaacacgctcagaa

SEQ ID NO: 1196 - DNA, 20 bp, synthetic construct
  source 1..20: mol_type = other DNA
accaacatagaaaattatcc

SEQ ID NO: 1197 - DNA, 20 bp, synthetic construct
  source 1..20: mol_type = other DNA
agtaaagatcaaactgtgca

SEQ ID NO: 1198 - DNA, 20 bp, synthetic construct
  source 1..20: mol_type = other DNA
tgggttaaaaacaaatgtgg

SEQ ID NO: 1199 - DNA, 20 bp, synthetic construct
  source 1..20: mol_type = other DNA
tcagcttctcaaatcaggtg

SEQ ID NO: 1200 - DNA, 20 bp, synthetic construct
  source 1..20: mol_type = other DNA
tagtaattcttccaggccat

SEQ ID NO: 1201 - DNA, 20 bp, synthetic construct
  source 1..20: mol_type = other DNA
ttctggcctctttatattaa

SEQ ID NO: 1202 - DNA, 20 bp, synthetic construct
  source 1..20: mol_type = other DNA
cttgagtcctttcagataag

SEQ ID NO: 1203 - DNA, 20 bp, synthetic construct
  source 1..20: mol_type = other DNA
tctgatattaaaacatccag

SEQ ID NO: 1204 - DNA, 20 bp, synthetic construct
  source 1..20: mol_type = other DNA
gcatatggaaaaaagttctc

SEQ ID NO: 1205 - DNA, 20 bp, synthetic construct
  source 1..20: mol_type = other DNA
tactgaaacaataaacttgt

SEQ ID NO: 1206 - DNA, 20 bp, synthetic construct
  source 1..20: mol_type = other DNA
tcttcctccttttatatctg

SEQ ID NO: 1207 - DNA, 20 bp, synthetic construct
  source 1..20: mol_type = other DNA
ggattaaaaattatgacctc

SEQ ID NO: 1208 - DNA, 20 bp, synthetic construct
  source 1..20: mol_type = other DNA
ggagcagttccttaactatc

SEQ ID NO: 1209 - DNA, 20 bp, synthetic construct
  source 1..20: mol_type = other DNA
ccccttacccaaacccttgg

SEQ ID NO: 1210 - DNA, 20 bp, synthetic construct
  source 1..20: mol_type = other DNA
agagataatttttaatgcag

SEQ ID NO: 1211 - DNA, 20 bp, synthetic construct
  source 1..20: mol_type = other DNA
ccattaaacatttattttgc

SEQ ID NO: 1212 - DNA, 20 bp, synthetic construct
  source 1..20: mol_type = other DNA
tctatattcccttaaccgta

SEQ ID NO: 1213 - DNA, 20 bp, synthetic construct
  source 1..20: mol_type = other DNA
cattttcaaccttatgatat

SEQ ID NO: 1214 - DNA, 20 bp, synthetic construct
  source 1..20: mol_type = other DNA
cagacattcctttaatatgc

SEQ ID NO: 1215 - DNA, 20 bp, synthetic construct
  source 1..20: mol_type = other DNA
tagaacttttaaagcaaggc

SEQ ID NO: 1216 - DNA, 20 bp, synthetic construct
  source 1..20: mol_type = other DNA
agtcaaatagtctatcagta

SEQ ID NO: 1217 - DNA, 20 bp, synthetic construct
  source 1..20: mol_type = other DNA
acatgattttaaaagtctta

SEQ ID NO: 1218 - DNA, 20 bp, synthetic construct
  source 1..20: mol_type = other DNA
tccccacacccttaaactgc

SEQ ID NO: 1219 - DNA, 20 bp, synthetic construct
  source 1..20: mol_type = other DNA
tacacataaatttatatctg

SEQ ID NO: 1220 - DNA, 20 bp, synthetic construct
  source 1..20: mol_type = other DNA
tggttctatatttatgtacc

SEQ ID NO: 1221 - DNA, 20 bp, synthetic construct
  source 1..20: mol_type = other DNA
ttgtctaaacctgtttgagg

SEQ ID NO: 1222 - DNA, 20 bp, synthetic construct
  source 1..20: mol_type = other DNA
gctaccaaaatacagaactt

SEQ ID NO: 1223 - DNA, 20 bp, synthetic construct
  source 1..20: mol_type = other DNA
gcaccattttaaaaatggct

SEQ ID NO: 1224 - DNA, 20 bp, synthetic construct
  source 1..20: mol_type = other DNA
tcatctaaacctaatacggc

SEQ ID NO: 1225 - DNA, 20 bp, synthetic construct
  source 1..20: mol_type = other DNA
tctgtcttttcctggtaaga

SEQ ID NO: 1226 - DNA, 20 bp, synthetic construct
  source 1..20: mol_type = other DNA
ctgttgtttgccacatttcc

SEQ ID NO: 1227 - DNA, 20 bp, synthetic construct
  source 1..20: mol_type = other DNA
ccagagctaattcctaggag

SEQ ID NO: 1228 - DNA, 20 bp, synthetic construct
  source 1..20: mol_type = other DNA
ttgggcagtgaaagaaatgg

SEQ ID NO: 1229 - DNA, 20 bp, synthetic construct
  source 1..20: mol_type = other DNA
acctacagtgacatctcata

SEQ ID NO: 1230 - DNA, 20 bp, synthetic construct
  source 1..20: mol_type = other DNA
tctgttcacaaaaatgtgtt

SEQ ID NO: 1231 - DNA, 20 bp, synthetic construct
  source 1..20: mol_type = other DNA
ctctttcatttaatcattaa

SEQ ID NO: 1232 - DNA, 20 bp, synthetic construct
  source 1..20: mol_type = other DNA
tccccaatcaaatttgtgat

SEQ ID NO: 1233 - DNA, 20 bp, synthetic construct
  source 1..20: mol_type = other DNA
gtagtggtacacacccatag

SEQ ID NO: 1234 - DNA, 20 bp, synthetic construct
  source 1..20: mol_type = other DNA
ggcatctttccacagtctta

SEQ ID NO: 1235 - DNA, 20 bp, synthetic construct
  source 1..20: mol_type = other DNA
ccgagccatctaagttgaag

SEQ ID NO: 1236 - DNA, 20 bp, synthetic construct
  source 1..20: mol_type = other DNA
atccagttcatactcagaaa

SEQ ID NO: 1237 - DNA, 20 bp, synthetic construct
  source 1..20: mol_type = other DNA
cacccacgccaggacagtcg

SEQ ID NO: 1238 - DNA, 20 bp, synthetic construct
  source 1..20: mol_type = other DNA
ttccagcaccagaacagaca

SEQ ID NO: 1239 - DNA, 20 bp, synthetic construct
  source 1..20: mol_type = other DNA
tctgtataataatgtaatgc

SEQ ID NO: 1240 - DNA, 20 bp, synthetic construct
  source 1..20: mol_type = other DNA
gttctatttaaaacactgaa

SEQ ID NO: 1241 - DNA, 20 bp, synthetic construct
  source 1..20: mol_type = other DNA
catacaaatttcgcctgttg

SEQ ID NO: 1242 - DNA, 20 bp, synthetic construct
  source 1..20: mol_type = other DNA
actactatatctaaacacta

SEQ ID NO: 1243 - DNA, 20 bp, synthetic construct
  source 1..20: mol_type = other DNA
taccccttcctccatccatc

SEQ ID NO: 1244 - DNA, 20 bp, synthetic construct
  source 1..20: mol_type = other DNA
ctcaatatagcccatttttt

SEQ ID NO: 1245 - DNA, 20 bp, synthetic construct
  source 1..20: mol_type = other DNA
gacctcccccagggagagga

SEQ ID NO: 1246 - DNA, 20 bp, synthetic construct
  source 1..20: mol_type = other DNA
ttctcctctttataccaggg

SEQ ID NO: 1247 - DNA, 20 bp, synthetic construct
  source 1..20: mol_type = other DNA
actatttttttactacctcc

SEQ ID NO: 1248 - DNA, 20 bp, synthetic construct
  source 1..20: mol_type = other DNA
accagtgaccacactatccg

SEQ ID NO: 1249 - DNA, 20 bp, synthetic construct
  source 1..20: mol_type = other DNA
ccttgaatttaaaacccata

SEQ ID NO: 1250 - DNA, 20 bp, synthetic construct
  source 1..20: mol_type = other DNA
gaaagttaaaatcttgttgc

SEQ ID NO: 1251 - DNA, 20 bp, synthetic construct
  source 1..20: mol_type = other DNA
ctttttgcctaaattctgcc

SEQ ID NO: 1252 - DNA, 20 bp, synthetic construct
  source 1..20: mol_type = other DNA
tctcaccaacctcatctctc

SEQ ID NO: 1253 - DNA, 20 bp, synthetic construct
  source 1..20: mol_type = other DNA
aacaactaactatatattgt

SEQ ID NO: 1254 - DNA, 20 bp, synthetic construct
  source 1..20: mol_type = other DNA
agtgcaaaagtcaggataca

SEQ ID NO: 1255 - DNA, 20 bp, synthetic construct
  source 1..20: mol_type = other DNA
tcagaagaccagaagcctta

SEQ ID NO: 1256 - DNA, 20 bp, synthetic construct
  source 1..20: mol_type = other DNA
acatttacatcacacacaga

SEQ ID NO: 1257 - DNA, 20 bp, synthetic construct
  source 1..20: mol_type = other DNA
ggattttatcccagtcattg

SEQ ID NO: 1258 - DNA, 20 bp, synthetic construct
  source 1..20: mol_type = other DNA
gaggaatgaaaatggtagat

SEQ ID NO: 1259 - DNA, 20 bp, synthetic construct
  source 1..20: mol_type = other DNA
cagatgagaattaaactgct

SEQ ID NO: 1260 - DNA, 20 bp, synthetic construct
  source 1..20: mol_type = other DNA
agagtcatacatatagactt

SEQ ID NO: 1261 - DNA, 20 bp, synthetic construct
  source 1..20: mol_type = other DNA
atggagttcaggatacacca

SEQ ID NO: 1262 - DNA, 20 bp, synthetic construct
  source 1..20: mol_type = other DNA
ggtcttagattttatgagct

SEQ ID NO: 1263 - DNA, 20 bp, synthetic construct
  source 1..20: mol_type = other DNA
ggccccggccaccagggttg

SEQ ID NO: 1264 - DNA, 20 bp, synthetic construct
  source 1..20: mol_type = other DNA
ggatactctaccaaaacttc

SEQ ID NO: 1265 - DNA, 20 bp, synthetic construct
  source 1..20: mol_type = other DNA
gtttcctttcccccacgctg

SEQ ID NO: 1266 - DNA, 20 bp, synthetic construct
  source 1..20: mol_type = other DNA
tgcactagtaaaaagcagaa

SEQ ID NO: 1267 - DNA, 20 bp, synthetic construct
  source 1..20: mol_type = other DNA
ttttttccccaaagagttta

SEQ ID NO: 1268 - DNA, 20 bp, synthetic construct
  source 1..20: mol_type = other DNA
aaggttctttaaaagttcat

SEQ ID NO: 1269 - DNA, 20 bp, synthetic construct
  source 1..20: mol_type = other DNA
tgggtttgtaccaaacatta

SEQ ID NO: 1270 - DNA, 20 bp, synthetic construct
  source 1..20: mol_type = other DNA
ctaaacctattcaaatgttt

SEQ ID NO: 1271 - DNA, 20 bp, synthetic construct
  source 1..20: mol_type = other DNA
atgatgttcctattgctcca

SEQ ID NO: 1272 - DNA, 20 bp, synthetic construct
  source 1..20: mol_type = other DNA
tcttcctatttgaagagaaa

SEQ ID NO: 1273 - DNA, 20 bp, synthetic construct
  source 1..20: mol_type = other DNA
gggaaaacgaaaagttgacc

SEQ ID NO: 1274 - DNA, 20 bp, synthetic construct
  source 1..20: mol_type = other DNA
tcagtaaagatcaaactgtg

SEQ ID NO: 1275 - DNA, 20 bp, synthetic construct
  source 1..20: mol_type = other DNA
tctgggttaaaaacaaatgt

SEQ ID NO: 1276 - DNA, 20 bp, synthetic construct
  source 1..20: mol_type = other DNA
cttcagcttctcaaatcagg

SEQ ID NO: 1277 - DNA, 20 bp, synthetic construct
  source 1..20: mol_type = other DNA
ataggtatagtttaagagcc

SEQ ID NO: 1278 - DNA, 20 bp, synthetic construct
  source 1..20: mol_type = other DNA
atgctccgtatttattctgg

SEQ ID NO: 1279 - DNA, 20 bp, synthetic construct
  source 1..20: mol_type = other DNA
gacttgagtcctttcagata

SEQ ID NO: 1280 - DNA, 20 bp, synthetic construct
  source 1..20: mol_type = other DNA
atctgatattaaaacatcca

SEQ ID NO: 1281 - DNA, 20 bp, synthetic construct
  source 1..20: mol_type = other DNA
tacaatattttacactggaa

SEQ ID NO: 1282 - DNA, 20 bp, synthetic construct
  source 1..20: mol_type = other DNA
gcactgttattttattagta

SEQ ID NO: 1283 - DNA, 20 bp, synthetic construct
  source 1..20: mol_type = other DNA
ctgtggttttaaaggctgta

SEQ ID NO: 1284 - DNA, 20 bp, synthetic construct
  source 1..20: mol_type = other DNA
ggttttaaaaacatcctcct

SEQ ID NO: 1285 - DNA, 20 bp, synthetic construct
  source 1..20: mol_type = other DNA
ttttagcacctttaaactct

SEQ ID NO: 1286 - DNA, 20 bp, synthetic construct
  source 1..20: mol_type = other DNA
ctctcattttaaagttttct

SEQ ID NO: 1287 - DNA, 20 bp, synthetic construct
  source 1..20: mol_type = other DNA
atctttattcaaaaatgcaa

SEQ ID NO: 1288 - DNA, 20 bp, synthetic construct
  source 1..20: mol_type = other DNA
ttcatgttttaaagctgaga

SEQ ID NO: 1289 - DNA, 20 bp, synthetic construct
  source 1..20: mol_type = other DNA
ctcacaattcaaaattattc

SEQ ID NO: 1290 - DNA, 20 bp, synthetic construct
  source 1..20: mol_type = other DNA
aaccttagaaatgtacattt

SEQ ID NO: 1291 - DNA, 20 bp, synthetic construct
  source 1..20: mol_type = other DNA
ctagcaattcaaaacaatat

SEQ ID NO: 1292 - DNA, 20 bp, synthetic construct
  source 1..20: mol_type = other DNA
cttctccttccttaatagat

SEQ ID NO: 1293 - DNA, 20 bp, synthetic construct
  source 1..20: mol_type = other DNA
tctcaaggcccttaattgcc

SEQ ID NO: 1294 - DNA, 20 bp, synthetic construct
  source 1..20: mol_type = other DNA
acttttaaatccccctaaag

SEQ ID NO: 1295 - DNA, 20 bp, synthetic construct
  source 1..20: mol_type = other DNA
ctcacatttctttatacaca

SEQ ID NO: 1296 - DNA, 20 bp, synthetic construct
  source 1..20: mol_type = other DNA
gtgagattttaaagacattc

SEQ ID NO: 1297 - DNA, 20 bp, synthetic construct
  source 1..20: mol_type = other DNA
gatgccaaactattatctca

SEQ ID NO: 1298 - DNA, 20 bp, synthetic construct
  source 1..20: mol_type = other DNA
agacaattttaaaagcttcc

SEQ ID NO: 1299 - DNA, 20 bp, synthetic construct
  source 1..20: mol_type = other DNA
tctcttaaccaaagaatctg

SEQ ID NO: 1300 - DNA, 20 bp, synthetic construct
  source 1..20: mol_type = other DNA
atgctgttcctttataacgg

SEQ ID NO: 1301 - DNA, 20 bp, synthetic construct
  source 1..20: mol_type = other DNA
aatttctaaatttagcccag

SEQ ID NO: 1302 - DNA, 20 bp, synthetic construct
  source 1..20: mol_type = other DNA
tcccctcactccaacggcat

SEQ ID NO: 1303 - DNA, 20 bp, synthetic construct
  source 1..20: mol_type = other DNA
ctcccatgaaaccacaataa

SEQ ID NO: 1304 - DNA, 20 bp, synthetic construct
  source 1..20: mol_type = other DNA
ctgacttttatatgcaaacc

SEQ ID NO: 1305 - DNA, 20 bp, synthetic construct
  source 1..20: mol_type = other DNA
ctcgatagccaggaaagctc

SEQ ID NO: 1306 - DNA, 20 bp, synthetic construct
  source 1..20: mol_type = other DNA
actgtaaacctacagtgaca

SEQ ID NO: 1307 - DNA, 20 bp, synthetic construct
  source 1..20: mol_type = other DNA
ctctgttcacaaaaatgtgt

SEQ ID NO: 1308 - DNA, 20 bp, synthetic construct
  source 1..20: mol_type = other DNA
ttctctttcatttaatcatt

SEQ ID NO: 1309 - DNA, 20 bp, synthetic construct
  source 1..20: mol_type = other DNA
ttccccaatcaaatttgtga

SEQ ID NO: 1310 - DNA, 20 bp, synthetic construct
  source 1..20: mol_type = other DNA
gagattatctcctatgaaga

SEQ ID NO: 1311 - DNA, 20 bp, synthetic construct
  source 1..20: mol_type = other DNA
agcatttttctcctacattg

SEQ ID NO: 1312 - DNA, 20 bp, synthetic construct
  source 1..20: mol_type = other DNA
ggcccgagccatctaagttg

SEQ ID NO: 1313 - DNA, 20 bp, synthetic construct
  source 1..20: mol_type = other DNA
aatccagttcatactcagaa

SEQ ID NO: 1314 - DNA, 20 bp, synthetic construct
  source 1..20: mol_type = other DNA
actcacacccacgccaggac

SEQ ID NO: 1315 - DNA, 20 bp, synthetic construct
  source 1..20: mol_type = other DNA
ccacaaacaaaaatgtggtt

SEQ ID NO: 1316 - DNA, 20 bp, synthetic construct
  source 1..20: mol_type = other DNA
ctgttctgtataataatgta

SEQ ID NO: 1317 - DNA, 20 bp, synthetic construct
  source 1..20: mol_type = other DNA
tgttctatttaaaacactga

SEQ ID NO: 1318 - DNA, 20 bp, synthetic construct
  source 1..20: mol_type = other DNA
gacatacaaatttcgcctgt

SEQ ID NO: 1319 - DNA, 20 bp, synthetic construct
  source 1..20: mol_type = other DNA
aactactatatctaaacact

SEQ ID NO: 1320 - DNA, 20 bp, synthetic construct
  source 1..20: mol_type = other DNA
ctgcctaccccttcctccat

SEQ ID NO: 1321 - DNA, 20 bp, synthetic construct
  source 1..20: mol_type = other DNA
gacagctcaatatagcccat

SEQ ID NO: 1322 - DNA, 20 bp, synthetic construct
  source 1..20: mol_type = other DNA
agccagaactaaagtgggct

SEQ ID NO: 1323 - DNA, 20 bp, synthetic construct
  source 1..20: mol_type = other DNA
ccttctcctctttataccag

SEQ ID NO: 1324 - DNA, 20 bp, synthetic construct
  source 1..20: mol_type = other DNA
atactatttttttactacct

SEQ ID NO: 1325 - DNA, 20 bp, synthetic construct
  source 1..20: mol_type = other DNA
gacaccagtgaccacactat

SEQ ID NO: 1326 - DNA, 20 bp, synthetic construct
  source 1..20: mol_type = other DNA
tccttgaatttaaaacccat

SEQ ID NO: 1327 - DNA, 20 bp, synthetic construct
  source 1..20: mol_type = other DNA
tgaaagttaaaatcttgttg

SEQ ID NO: 1328 - DNA, 20 bp, synthetic construct
  source 1..20: mol_type = other DNA
tctttttgcctaaattctgc

SEQ ID NO: 1329 - DNA, 20 bp, synthetic construct
  source 1..20: mol_type = other DNA
tcctctcaccaacctcatct

SEQ ID NO: 1330 - DNA, 20 bp, synthetic construct
  source 1..20: mol_type = other DNA
cttttagaaactaactctgg

SEQ ID NO: 1331 - DNA, 20 bp, synthetic construct
  source 1..20: mol_type = other DNA
gtactataattgattagtgc

SEQ ID NO: 1332 - DNA, 20 bp, synthetic construct
  source 1..20: mol_type = other DNA
gtgacattcagaagaccaga

SEQ ID NO: 1333 - DNA, 20 bp, synthetic construct
  source 1..20: mol_type = other DNA
actacatttacatcacacac

SEQ ID NO: 1334 - DNA, 20 bp, synthetic construct
  source 1..20: mol_type = other DNA
ttaggattttatcccagtca

SEQ ID NO: 1335 - DNA, 20 bp, synthetic construct
  source 1..20: mol_type = other DNA
gcattatagaaaatactaaa

SEQ ID NO: 1336 - DNA, 20 bp, synthetic construct
  source 1..20: mol_type = other DNA
gcagatgagaattaaactgc

SEQ ID NO: 1337 - DNA, 20 bp, synthetic construct
  source 1..20: mol_type = other DNA
tcatatagagtcatacatat

SEQ ID NO: 1338 - DNA, 20 bp, synthetic construct
  source 1..20: mol_type = other DNA
tgaacattccaaagtggagc

SEQ ID NO: 1339 - DNA, 20 bp, synthetic construct
  source 1..20: mol_type = other DNA
gcggtcttagattttatgag

SEQ ID NO: 1340 - DNA, 20 bp, synthetic construct
  source 1..20: mol_type = other DNA
ccctgccggcccatgcctcc

SEQ ID NO: 1341 - DNA, 20 bp, synthetic construct
  source 1..20: mol_type = other DNA
cacaaaaaaaggatactcta

SEQ ID NO: 1342 - DNA, 20 bp, synthetic construct
  source 1..20: mol_type = other DNA
atctggatacaaatgataag

SEQ ID NO: 1343 - DNA, 20 bp, synthetic construct
  source 1..20: mol_type = other DNA
gtccaccacaacaccctggt

SEQ ID NO: 1344 - DNA, 20 bp, synthetic construct
  source 1..20: mol_type = other DNA
cagagctgaaatgtagttac

SEQ ID NO: 1345 - DNA, 20 bp, synthetic construct
  source 1..20: mol_type = other DNA
gcaaggttctttaaaagttc

SEQ ID NO: 1346 - DNA, 20 bp, synthetic construct
  source 1..20: mol_type = other DNA
atgaaataccctttctgggt

SEQ ID NO: 1347 - DNA, 20 bp, synthetic construct
  source 1..20: mol_type = other DNA
tagctattctaaacctattc

SEQ ID NO: 1348 - DNA, 20 bp, synthetic construct
  source 1..20: mol_type = other DNA
tgatgatgttcctattgctc

SEQ ID NO: 1349 - DNA, 20 bp, synthetic construct
  source 1..20: mol_type = other DNA
gaagaatttctacccctgtc

SEQ ID NO: 1350 - DNA, 20 bp, synthetic construct
  source 1..20: mol_type = other DNA
atcccaaactaaactgggtg

SEQ ID NO: 1351 - DNA, 20 bp, synthetic construct
  source 1..20: mol_type = other DNA
aacatatttcagtaaagatc

SEQ ID NO: 1352 - DNA, 20 bp, synthetic construct
  source 1..20: mol_type = other DNA
tctatttcagaaattctggg

SEQ ID NO: 1353 - DNA, 20 bp, synthetic construct
  source 1..20: mol_type = other DNA
tgcttcaaaattttgttttc

SEQ ID NO: 1354 - DNA, 20 bp, synthetic construct
  source 1..20: mol_type = other DNA
ttcccctccctcagacgagg

SEQ ID NO: 1355 - DNA, 20 bp, synthetic construct
  source 1..20: mol_type = other DNA
attctgagaagatgctccgt

SEQ ID NO: 1356 - DNA, 20 bp, synthetic construct
  source 1..20: mol_type = other DNA
aagacttgagtcctttcaga

SEQ ID NO: 1357 - DNA, 20 bp, synthetic construct
  source 1..20: mol_type = other DNA
gatctgatattaaaacatcc

SEQ ID NO: 1358 - DNA, 20 bp, synthetic construct
  source 1..20: mol_type = other DNA
agtacaatattttacactgg

SEQ ID NO: 1359 - DNA, 20 bp, synthetic construct
  source 1..20: mol_type = other DNA
gtcaagttttaaaatgtgac

SEQ ID NO: 1360 - DNA, 20 bp, synthetic construct
  source 1..20: mol_type = other DNA
actgaaacaatttatctaag

SEQ ID NO: 1361 - DNA, 20 bp, synthetic construct
  source 1..20: mol_type = other DNA
acaaaaataatttaagccac

SEQ ID NO: 1362 - DNA, 20 bp, synthetic construct
  source 1..20: mol_type = other DNA
tactatcacctttaaacttt

SEQ ID NO: 1363 - DNA, 20 bp, synthetic construct
  source 1..20: mol_type = other DNA
accgccaaaaccaaccaggg

SEQ ID NO: 1364 - DNA, 20 bp, synthetic construct
  source 1..20: mol_type = other DNA
ctaatctatcaaataaagga

SEQ ID NO: 1365 - DNA, 20 bp, synthetic construct
  source 1..20: mol_type = other DNA
gagaggtttcattatgtaaa

SEQ ID NO: 1366 - DNA, 20 bp, synthetic construct
  source 1..20: mol_type = other DNA
gcacttagacaatgctgcag

SEQ ID NO: 1367 - DNA, 20 bp, synthetic construct
  source 1..20: mol_type = other DNA
ggtaagttattttaaaactt

SEQ ID NO: 1368 - DNA, 20 bp, synthetic construct
  source 1..20: mol_type = other DNA
agttttacgatatatgaatc

SEQ ID NO: 1369 - DNA, 20 bp, synthetic construct
  source 1..20: mol_type = other DNA
taccattatttttagctttt

SEQ ID NO: 1370 - DNA, 20 bp, synthetic construct
  source 1..20: mol_type = other DNA
cagtttattctttacccaaa

SEQ ID NO: 1371 - DNA, 20 bp, synthetic construct
  source 1..20: mol_type = other DNA
cccacattttaaagatgcag

SEQ ID NO: 1372 - DNA, 20 bp, synthetic construct
  source 1..20: mol_type = other DNA
tccagaaacctttattattg

SEQ ID NO: 1373 - DNA, 20 bp, synthetic construct
  source 1..20: mol_type = other DNA
aacaggttacaaatacggtt

SEQ ID NO: 1374 - DNA, 20 bp, synthetic construct
  source 1..20: mol_type = other DNA
attctgttttaaattccttt

SEQ ID NO: 1375 - DNA, 20 bp, synthetic construct
  source 1..20: mol_type = other DNA
atgcaatttcaaaagctggc

SEQ ID NO: 1376 - DNA, 20 bp, synthetic construct
  source 1..20: mol_type = other DNA
gtggatactttttaaaactc

SEQ ID NO: 1377 - DNA, 20 bp, synthetic construct
  source 1..20: mol_type = other DNA
gtcgcaaacctttatggagt

SEQ ID NO: 1378 - DNA, 20 bp, synthetic construct
  source 1..20: mol_type = other DNA
caaatccaaatttattcttc

SEQ ID NO: 1379 - DNA, 20 bp, synthetic construct
  source 1..20: mol_type = other DNA
catctaatcccctcactcca

SEQ ID NO: 1380 - DNA, 20 bp, synthetic construct
  source 1..20: mol_type = other DNA
gcctcccatgaaaccacaat

SEQ ID NO: 1381 - DNA, 20 bp, synthetic construct
  source 1..20: mol_type = other DNA
cctgacttttatatgcaaac

SEQ ID NO: 1382 - DNA, 20 bp, synthetic construct
  source 1..20: mol_type = other DNA
aagtacgctcgatagccagg

SEQ ID NO: 1383 - DNA, 20 bp, synthetic construct
  source 1..20: mol_type = other DNA
aagactgtaaacctacagtg

SEQ ID NO: 1384 - DNA, 20 bp, synthetic construct
  source 1..20: mol_type = other DNA
cctctgttcacaaaaatgtg

SEQ ID NO: 1385 - DNA, 20 bp, synthetic construct
  source 1..20: mol_type = other DNA
atttctctttcatttaatca

SEQ ID NO: 1386 - DNA, 20 bp, synthetic construct
  source 1..20: mol_type = other DNA
cttccccaatcaaatttgtg

SEQ ID NO: 1387 - DNA, 20 bp, synthetic construct
  source 1..20: mol_type = other DNA
agagattatctcctatgaag

SEQ ID NO: 1388 - DNA, 20 bp, synthetic construct
  source 1..20: mol_type = other DNA
agggatagtgacaaacacgg

SEQ ID NO: 1389 - DNA, 20 bp, synthetic construct
  source 1..20: mol_type = other DNA
agggcccgagccatctaagt

SEQ ID NO: 1390 - DNA, 20 bp, synthetic construct
  source 1..20: mol_type = other DNA
cccctcaaatccagttcata

SEQ ID NO: 1391 - DNA, 20 bp, synthetic construct
  source 1..20: mol_type = other DNA
catcatgataacaactgctg

SEQ ID NO: 1392 - DNA, 20 bp, synthetic construct
  source 1..20: mol_type = other DNA
cccacaaacaaaaatgtggt

SEQ ID NO: 1393 - DNA, 20 bp, synthetic construct
  source 1..20: mol_type = other DNA
gagtaaaatgatcagtgggt

SEQ ID NO: 1394 - DNA, 20 bp, synthetic construct
  source 1..20: mol_type = other DNA
gtgttctatttaaaacactg

SEQ ID NO: 1395 - DNA, 20 bp, synthetic construct
  source 1..20: mol_type = other DNA
agacatacaaatttcgcctg

SEQ ID NO: 1396 - DNA, 20 bp, synthetic construct
  source 1..20: mol_type = other DNA
gtcaataactactatatcta

SEQ ID NO: 1397 - DNA, 20 bp, synthetic construct
  source 1..20: mol_type = other DNA
tctgcctaccccttcctcca

SEQ ID NO: 1398 - DNA, 20 bp, synthetic construct
  source 1..20: mol_type = other DNA
ccacagataaccaaagcacg

SEQ ID NO: 1399 - DNA, 20 bp, synthetic construct
  source 1..20: mol_type = other DNA
ccagccagaactaaagtggg

SEQ ID NO: 1400 - DNA, 20 bp, synthetic construct
  source 1..20: mol_type = other DNA
ggccccttctcctctttata

SEQ ID NO: 1401 - DNA, 20 bp, synthetic construct
  source 1..20: mol_type = other DNA
tgatactatttttttactac

SEQ ID NO: 1402 - DNA, 20 bp, synthetic construct
  source 1..20: mol_type = other DNA
gagacagaacatacacgcaa

SEQ ID NO: 1403 - DNA, 20 bp, synthetic construct
  source 1..20: mol_type = other DNA
attccttgaatttaaaaccc

SEQ ID NO: 1404 - DNA, 20 bp, synthetic construct
  source 1..20: mol_type = other DNA
gtgaaagttaaaatcttgtt

SEQ ID NO: 1405 - DNA, 20 bp, synthetic construct
  source 1..20: mol_type = other DNA
tgtttctttttgcctaaatt

SEQ ID NO: 1406 - DNA, 20 bp, synthetic construct
  source 1..20: mol_type = other DNA
ttttcctctcaccaacctca

SEQ ID NO: 1407 - DNA, 20 bp, synthetic construct
  source 1..20: mol_type = other DNA
acttttagaaactaactctg

SEQ ID NO: 1408 - DNA, 20 bp, synthetic construct
  source 1..20: mol_type = other DNA
gccctttataacaggtacta

SEQ ID NO: 1409 - DNA, 20 bp, synthetic construct
  source 1..20: mol_type = other DNA
tgtgacattcagaagaccag

SEQ ID NO: 1410 - DNA, 20 bp, synthetic construct
  source 1..20: mol_type = other DNA
tcaaaactacatttacatca

SEQ ID NO: 1411 - DNA, 20 bp, synthetic construct
  source 1..20: mol_type = other DNA
ggtttaggattttatcccag

SEQ ID NO: 1412 - DNA, 20 bp, synthetic construct
  source 1..20: mol_type = other DNA
tgcattatagaaaatactaa

SEQ ID NO: 1413 - DNA, 20 bp, synthetic construct
  source 1..20: mol_type = other DNA
ggcagatgagaattaaactg

SEQ ID NO: 1414 - DNA, 20 bp, synthetic construct
  source 1..20: mol_type = other DNA
cagggcttctcatatagagt

SEQ ID NO: 1415 - DNA, 20 bp, synthetic construct
  source 1..20: mol_type = other DNA
ggcacttgaacattccaaag

SEQ ID NO: 1416 - DNA, 20 bp, synthetic construct
  source 1..20: mol_type = other DNA
gctcacaagcccagcgcggt

SEQ ID NO: 1417 - DNA, 20 bp, synthetic construct
  source 1..20: mol_type = other DNA
tgttgtaaaccaagctccac

SEQ ID NO: 1418 - DNA, 20 bp, synthetic construct
  source 1..20: mol_type = other DNA
gtccaaacacaaaaaaagga

SEQ ID NO: 1419 - DNA, 20 bp, synthetic construct
  source 1..20: mol_type = other DNA
tattttagcctacagtacag

SEQ ID NO: 1420 - DNA, 20 bp, synthetic construct
  source 1..20: mol_type = other DNA
cctgtccaccacaacaccct

SEQ ID NO: 1421 - DNA, 20 bp, synthetic construct
  source 1..20: mol_type = other DNA
tcagcaattctgcagagctg

SEQ ID NO: 1422 - DNA, 20 bp, synthetic construct
  source 1..20: mol_type = other DNA
aagttataaactcaatatgt

SEQ ID NO: 1423 - DNA, 20 bp, synthetic construct
  source 1..20: mol_type = other DNA
tatgaaataccctttctggg

SEQ ID NO: 1424 - DNA, 20 bp, synthetic construct
  source 1..20: mol_type = other DNA
tctagctattctaaacctat

SEQ ID NO: 1425 - DNA, 20 bp, synthetic construct
  source 1..20: mol_type = other DNA
ccacaaaaattatgatgatg

SEQ ID NO: 1426 - DNA, 20 bp, synthetic construct
  source 1..20: mol_type = other DNA
cgaagaatttctacccctgt

SEQ ID NO: 1427 - DNA, 20 bp, synthetic construct
  source 1..20: mol_type = other DNA
tcatcccaaactaaactggg

SEQ ID NO: 1428 - DNA, 20 bp, synthetic construct
  source 1..20: mol_type = other DNA
gcaacatatttcagtaaaga

SEQ ID NO: 1429 - DNA, 20 bp, synthetic construct
  source 1..20: mol_type = other DNA
cttaaattctctatttcaga

SEQ ID NO: 1430 - DNA, 20 bp, synthetic construct
  source 1..20: mol_type = other DNA
gtgcttcaaaattttgtttt

SEQ ID NO: 1431 - DNA, 20 bp, synthetic construct
  source 1..20: mol_type = other DNA
accgagttcccctccctcag

SEQ ID NO: 1432 - DNA, 20 bp, synthetic construct
  source 1..20: mol_type = other DNA
acaggaatactattctgaga

SEQ ID NO: 1433 - DNA, 20 bp, synthetic construct
  source 1..20: mol_type = other DNA
gaagcctccaatgtatctgc

SEQ ID NO: 1434 - DNA, 20 bp, synthetic construct
  source 1..20: mol_type = other DNA
ggtgtctgttttcccttggc

SEQ ID NO: 1435 - DNA, 20 bp, synthetic construct
  source 1..20: mol_type = other DNA
aagtacaatattttacactg

SEQ ID NO: 1436 - DNA, 20 bp, synthetic construct
  source 1..20: mol_type = other DNA
ggccataaaattgtaaactg

SEQ ID NO: 1437 - DNA, 20 bp, synthetic construct
  source 1..20: mol_type = other DNA
aacatctaaatttataatga

SEQ ID NO: 1438 - DNA, 20 bp, synthetic construct
  source 1..20: mol_type = other DNA
aggtggttacaaacataaat

SEQ ID NO: 1439 - DNA, 20 bp, synthetic construct
  source 1..20: mol_type = other DNA
agctaaaaacccaacatggg

SEQ ID NO: 1440 - DNA, 20 bp, synthetic construct
  source 1..20: mol_type = other DNA
gacagttatttttaagaggc

SEQ ID NO: 1441 - DNA, 20 bp, synthetic construct
  source 1..20: mol_type = other DNA
ttggacttttaaatgtaagt

SEQ ID NO: 1442 - DNA, 20 bp, synthetic construct
  source 1..20: mol_type = other DNA
tgtgtctaaatttatggtag

SEQ ID NO: 1443 - DNA, 20 bp, synthetic construct
  source 1..20: mol_type = other DNA
gttgaatttcaaaaatcaaa

SEQ ID NO: 1444 - DNA, 20 bp, synthetic construct
  source 1..20: mol_type = other DNA
caggaaaaaatacagggtgt

SEQ ID NO: 1445 - DNA, 20 bp, synthetic construct
  source 1..20: mol_type = other DNA
acctaaaaaaatatagatcc

SEQ ID NO: 1446 - DNA, 20 bp, synthetic construct
  source 1..20: mol_type = other DNA
ctaattaatccttaaattgc

SEQ ID NO: 1447 - DNA, 20 bp, synthetic construct
  source 1..20: mol_type = other DNA
tttcaatatatttacacact

SEQ ID NO: 1448 - DNA, 20 bp, synthetic construct
  source 1..20: mol_type = other DNA
ctcacacaaatttacattct

SEQ ID NO: 1449 - DNA, 20 bp, synthetic construct
  source 1..20: mol_type = other DNA
acctaaaaaatacatcttta

SEQ ID NO: 1450 - DNA, 20 bp, synthetic construct
  source 1..20: mol_type = other DNA
ctgaagattccttaatatct

SEQ ID NO: 1451 - DNA, 20 bp, synthetic construct
  source 1..20: mol_type = other DNA
ctaatgttttaaaactcttg

SEQ ID NO: 1452 - DNA, 20 bp, synthetic construct
  source 1..20: mol_type = other DNA
ttccaattttaaaaaacctg

SEQ ID NO: 1453 - DNA, 20 bp, synthetic construct
  source 1..20: mol_type = other DNA
ctgtcaaaaatataatacct

SEQ ID NO: 1454 - DNA, 20 bp, synthetic construct
  source 1..20: mol_type = other DNA
tgtcgcaaacctttatggag

SEQ ID NO: 1455 - DNA, 20 bp, synthetic construct
  source 1..20: mol_type = other DNA
aagtcctttcaaagccaagt

SEQ ID NO: 1456 - DNA, 20 bp, synthetic construct
  source 1..20: mol_type = other DNA
agcatctaatcccctcactc

SEQ ID NO: 1457 - DNA, 20 bp, synthetic construct
  source 1..20: mol_type = other DNA
aacccgtttaccctgcctcc

SEQ ID NO: 1458 - DNA, 20 bp, synthetic construct
  source 1..20: mol_type = other DNA
gcctgacttttatatgcaaa

SEQ ID NO: 1459 - DNA, 20 bp, synthetic construct
  source 1..20: mol_type = other DNA
acacttgtagaaagtacgct

SEQ ID NO: 1460 - DNA, 20 bp, synthetic construct
  source 1..20: mol_type = other DNA
cttccaaagactgtaaacct

SEQ ID NO: 1461 - DNA, 20 bp, synthetic construct
  source 1..20: mol_type = other DNA
gcctctgttcacaaaaatgt

SEQ ID NO: 1462 - DNA, 20 bp, synthetic construct
  source 1..20: mol_type = other DNA
aagccaatttctctttcatt

SEQ ID NO: 1463 - DNA, 20 bp, synthetic construct
  source 1..20: mol_type = other DNA
cacaacttccccaatcaaat

SEQ ID NO: 1464 - DNA, 20 bp, synthetic construct
  source 1..20: mol_type = other DNA
ctcaagagattatctcctat

SEQ ID NO: 1465 - DNA, 20 bp, synthetic construct
  source 1..20: mol_type = other DNA
acagggatagtgacaaacac

SEQ ID NO: 1466 - DNA, 20 bp, synthetic construct
  source 1..20: mol_type = other DNA
ctgtgaatcactttctcagg

SEQ ID NO: 1467 - DNA, 20 bp, synthetic construct
  source 1..20: mol_type = other DNA
acccctcaaatccagttcat

SEQ ID NO: 1468 - DNA, 20 bp, synthetic construct
  source 1..20: mol_type = other DNA
gtagacagccagtaagtaca

SEQ ID NO: 1469 - DNA, 20 bp, synthetic construct
  source 1..20: mol_type = other DNA
acccacaaacaaaaatgtgg

SEQ ID NO: 1470 - DNA, 20 bp, synthetic construct
  source 1..20: mol_type = other DNA
cgccaatgtgaaaaggcgac

SEQ ID NO: 1471 - DNA, 20 bp, synthetic construct
  source 1..20: mol_type = other DNA
agtgttctatttaaaacact

SEQ ID NO: 1472 - DNA, 20 bp, synthetic construct
  source 1..20: mol_type = other DNA
ccagacatacaaatttcgcc

SEQ ID NO: 1473 - DNA, 20 bp, synthetic construct
  source 1..20: mol_type = other DNA
agtcaataactactatatct

SEQ ID NO: 1474 - DNA, 20 bp, synthetic construct
  source 1..20: mol_type = other DNA
ccagcaagcccatgtgctca

SEQ ID NO: 1475 - DNA, 20 bp, synthetic construct
  source 1..20: mol_type = other DNA
agtaccacagataaccaaag

SEQ ID NO: 1476 - DNA, 20 bp, synthetic construct
  source 1..20: mol_type = other DNA
ctgtatggaaaaacattgca

SEQ ID NO: 1477 - DNA, 20 bp, synthetic construct
  source 1..20: mol_type = other DNA
atgatgatcattatgtagag

SEQ ID NO: 1478 - DNA, 20 bp, synthetic construct
  source 1..20: mol_type = other DNA
aatgatactatttttttact

SEQ ID NO: 1479 - DNA, 20 bp, synthetic construct
  source 1..20: mol_type = other DNA
ggagacagaacatacacgca

SEQ ID NO: 1480 - DNA, 20 bp, synthetic construct
  source 1..20: mol_type = other DNA
tctgtgaattccttgaattt

SEQ ID NO: 1481 - DNA, 20 bp, synthetic construct
  source 1..20: mol_type = other DNA
ggtgaaagttaaaatcttgt

SEQ ID NO: 1482 - DNA, 20 bp, synthetic construct
  source 1..20: mol_type = other DNA
tctttaatcacttcaaaggc

SEQ ID NO: 1483 - DNA, 20 bp, synthetic construct
  source 1..20: mol_type = other DNA
ggctttcccaataaacctgc

SEQ ID NO: 1484 - DNA, 20 bp, synthetic construct
  source 1..20: mol_type = other DNA
gtacttttagaaactaactc

SEQ ID NO: 1485 - DNA, 20 bp, synthetic construct
  source 1..20: mol_type = other DNA
aagccctttataacaggtac

SEQ ID NO: 1486 - DNA, 20 bp, synthetic construct
  source 1..20: mol_type = other DNA
gcccaacaccaggcagaggt

SEQ ID NO: 1487 - DNA, 20 bp, synthetic construct
  source 1..20: mol_type = other DNA
tttcaaaactacatttacat

SEQ ID NO: 1488 - DNA, 20 bp, synthetic construct
  source 1..20: mol_type = other DNA
ttgtaaattttacgaatagt

SEQ ID NO: 1489 - DNA, 20 bp, synthetic construct
  source 1..20: mol_type = other DNA
accatcaacagatctgcatt

SEQ ID NO: 1490 - DNA, 20 bp, synthetic construct
  source 1..20: mol_type = other DNA
gcctagccccaaacaggaaa

SEQ ID NO: 1491 - DNA, 20 bp, synthetic construct
  source 1..20: mol_type = other DNA
aggatgcaccagggcttctc

SEQ ID NO: 1492 - DNA, 20 bp, synthetic construct
  source 1..20: mol_type = other DNA
gggcctgttttctcctgaag

SEQ ID NO: 1493 - DNA, 20 bp, synthetic construct
  source 1..20: mol_type = other DNA
ggctcacaagcccagcgcgg

SEQ ID NO: 1494 - DNA, 20 bp, synthetic construct
  source 1..20: mol_type = other DNA
ctgttgtaaaccaagctcca

SEQ ID NO: 1495 - DNA, 20 bp, synthetic construct
  source 1..20: mol_type = other DNA
atgaccagccctgtccaaac

SEQ ID NO: 1496 - DNA, 20 bp, synthetic construct
  source 1..20: mol_type = other DNA
actgtgttattttagcctac

SEQ ID NO: 1497 - DNA, 20 bp, synthetic construct
  source 1..20: mol_type = other DNA
cccaaccccccttaccccat

SEQ ID NO: 1498 - DNA, 20 bp, synthetic construct
  source 1..20: mol_type = other DNA
cattgaaactttcaatatct

SEQ ID NO: 1499 - DNA, 20 bp, synthetic construct
  source 1..20: mol_type = other DNA
caggaatatcacacaagtta

SEQ ID NO: 1500 - DNA, 20 bp, synthetic construct
  source 1..20: mol_type = other DNA
ctatgaaataccctttctgg

SEQ ID NO: 1501 - DNA, 20 bp, synthetic construct
  source 1..20: mol_type = other DNA
ttctagctattctaaaccta

SEQ ID NO: 1502 - DNA, 20 bp, synthetic construct
  source 1..20: mol_type = other DNA
aaccacaaaaattatgatga

SEQ ID NO: 1503 - DNA, 20 bp, synthetic construct
  source 1..20: mol_type = other DNA
ccgaagaatttctacccctg

SEQ ID NO: 1504 - DNA, 20 bp, synthetic construct
  source 1..20: mol_type = other DNA
atcatcccaaactaaactgg

SEQ ID NO: 1505 - DNA, 20 bp, synthetic construct
  source 1..20: mol_type = other DNA
ttttggcaacatatttcagt

SEQ ID NO: 1506 - DNA, 20 bp, synthetic construct
  source 1..20: mol_type = other DNA
tgttcttaaattctctattt

SEQ ID NO: 1507 - DNA, 20 bp, synthetic construct
  source 1..20: mol_type = other DNA
gagtgcttcaaaattttgtt

SEQ ID NO: 1508 - DNA, 20 bp, synthetic construct
  source 1..20: mol_type = other DNA
cagtattctcaaatcgcaga

SEQ ID NO: 1509 - DNA, 20 bp, synthetic construct
  source 1..20: mol_type = other DNA
ggacaggaatactattctga

SEQ ID NO: 1510 - DNA, 20 bp, synthetic construct
  source 1..20: mol_type = other DNA
gggtgaagcctccaatgtat

SEQ ID NO: 1511 - DNA, 20 bp, synthetic construct
  source 1..20: mol_type = other DNA
ccctcaacccaagttctggt

SEQ ID NO: 1512 - DNA, 20 bp, synthetic construct
  source 1..20: mol_type = other DNA
gcaagtacaatattttacac

SEQ ID NO: 1513 - DNA, 20 bp, synthetic construct
  source 1..20: mol_type = other DNA
cactgaaaaatatatgttca

SEQ ID NO: 1514 - DNA, 20 bp, synthetic construct
  source 1..20: mol_type = other DNA
cactataaaaacatctaaca

SEQ ID NO: 1515 - DNA, 20 bp, synthetic construct
  source 1..20: mol_type = other DNA
ttcaacaatatttatgccca

SEQ ID NO: 1516 - DNA, 20 bp, synthetic construct
  source 1..20: mol_type = other DNA
cagctaaaaacccaacatgg

SEQ ID NO: 1517 - DNA, 20 bp, synthetic construct
  source 1..20: mol_type = other DNA
agttatatattttagctgaa

SEQ ID NO: 1518 - DNA, 20 bp, synthetic construct
  source 1..20: mol_type = other DNA
gctatattttaaaaaggatc

SEQ ID NO: 1519 - DNA, 20 bp, synthetic construct
  source 1..20: mol_type = other DNA
ctttcatttcaaacttactg

SEQ ID NO: 1520 - DNA, 20 bp, synthetic construct
  source 1..20: mol_type = other DNA
actttcttttaaattctaac

SEQ ID NO: 1521 - DNA, 20 bp, synthetic construct
  source 1..20: mol_type = other DNA
gatggtaatttttagaggtg

SEQ ID NO: 1522 - DNA, 20 bp, synthetic construct
  source 1..20: mol_type = other DNA
tctttctatatttatctata

SEQ ID NO: 1523 - DNA, 20 bp, synthetic construct
  source 1..20: mol_type = other DNA
gtttacaaaatatttgcaca

SEQ ID NO: 1524 - DNA, 20 bp, synthetic construct
  source 1..20: mol_type = other DNA
tctatcaaacctaatctatc

SEQ ID NO: 1525 - DNA, 20 bp, synthetic construct
  source 1..20: mol_type = other DNA
aaggaatttctttacaccat

SEQ ID NO: 1526 - DNA, 20 bp, synthetic construct
  source 1..20: mol_type = other DNA
gcacttcgaatttataccac

SEQ ID NO: 1527 - DNA, 20 bp, synthetic construct
  source 1..20: mol_type = other DNA
aacataaaaaatatacctaa

SEQ ID NO: 1528 - DNA, 20 bp, synthetic construct
  source 1..20: mol_type = other DNA
gctgttaaaatatgctttcc

SEQ ID NO: 1529 - DNA, 20 bp, synthetic construct
  source 1..20: mol_type = other DNA
gggcactacccttatcttaa

SEQ ID NO: 1530 - DNA, 20 bp, synthetic construct
  source 1..20: mol_type = other DNA
cctgtcaaaaatataatacc

SEQ ID NO: 1531 - DNA, 20 bp, synthetic construct
  source 1..20: mol_type = other DNA
cctttaaaaatatgcctttt

SEQ ID NO: 1532 - DNA, 20 bp, synthetic construct
  source 1..20: mol_type = other DNA
ccaataaaaccccacagggt

SEQ ID NO: 1533 - DNA, 20 bp, synthetic construct
  source 1..20: mol_type = other DNA
ctttagcatctaatcccctc

SEQ ID NO: 1534 - DNA, 20 bp, synthetic construct
  source 1..20: mol_type = other DNA
aaacccgtttaccctgcctc

SEQ ID NO: 1535 - DNA, 20 bp, synthetic construct
  source 1..20: mol_type = other DNA
ggcctgacttttatatgcaa

SEQ ID NO: 1536 - DNA, 20 bp, synthetic construct
  source 1..20: mol_type = other DNA
gttttcaaatcctagatgga

SEQ ID NO: 1537 - DNA, 20 bp, synthetic construct
  source 1..20: mol_type = other DNA
gggcccttccaaagactgta

SEQ ID NO: 1538 - DNA, 20 bp, synthetic construct
  source 1..20: mol_type = other DNA
acctcttttcacacctgcct

SEQ ID NO: 1539 - DNA, 20 bp, synthetic construct
  source 1..20: mol_type = other DNA
cacagggaagccaatttctc

SEQ ID NO: 1540 - DNA, 20 bp, synthetic construct
  source 1..20: mol_type = other DNA
catctcttcttccacaactt

SEQ ID NO: 1541 - DNA, 20 bp, synthetic construct
  source 1..20: mol_type = other DNA
ctctcaagagattatctcct

SEQ ID NO: 1542 - DNA, 20 bp, synthetic construct
  source 1..20: mol_type = other DNA
ctttcctcccacagcaccta

SEQ ID NO: 1543 - DNA, 20 bp, synthetic construct
  source 1..20: mol_type = other DNA
gatttatttttcagctgtga

SEQ ID NO: 1544 - DNA, 20 bp, synthetic construct
  source 1..20: mol_type = other DNA
tgcacccctcaaatccagtt

SEQ ID NO: 1545 - DNA, 20 bp, synthetic construct
  source 1..20: mol_type = other DNA
ccatcggtagacagccagta

SEQ ID NO: 1546 - DNA, 20 bp, synthetic construct
  source 1..20: mol_type = other DNA
ggtacaaagacccacaaaca

SEQ ID NO: 1547 - DNA, 20 bp, synthetic construct
  source 1..20: mol_type = other DNA
aacataatattcagtgctaa

SEQ ID NO: 1548 - DNA, 20 bp, synthetic construct
  source 1..20: mol_type = other DNA
gagtgttctatttaaaacac

SEQ ID NO: 1549 - DNA, 20 bp, synthetic construct
  source 1..20: mol_type = other DNA
tcccagacatacaaatttcg

SEQ ID NO: 1550 - DNA, 20 bp, synthetic construct
  source 1..20: mol_type = other DNA
tagtcaataactactatatc

SEQ ID NO: 1551 - DNA, 20 bp, synthetic construct
  source 1..20: mol_type = other DNA
gccagcaagcccatgtgctc

SEQ ID NO: 1552 - DNA, 20 bp, synthetic construct
  source 1..20: mol_type = other DNA
cagtaccacagataaccaaa

SEQ ID NO: 1553 - DNA, 20 bp, synthetic construct
  source 1..20: mol_type = other DNA
gctcagttaaaatctgaaag

SEQ ID NO: 1554 - DNA, 20 bp, synthetic construct
  source 1..20: mol_type = other DNA
gtgggctcaagatatcttcc

SEQ ID NO: 1555 - DNA, 20 bp, synthetic construct
  source 1..20: mol_type = other DNA
agaatgatactattttttta

SEQ ID NO: 1556 - DNA, 20 bp, synthetic construct
  source 1..20: mol_type = other DNA
gcctcccaccaggagacaga

SEQ ID NO: 1557 - DNA, 20 bp, synthetic construct
  source 1..20: mol_type = other DNA
gatgtcatcttcaactggaa

SEQ ID NO: 1558 - DNA, 20 bp, synthetic construct
  source 1..20: mol_type = other DNA
ttctttggtgaaagttaaaa

SEQ ID NO: 1559 - DNA, 20 bp, synthetic construct
  source 1..20: mol_type = other DNA
ttcttctttaatcacttcaa

SEQ ID NO: 1560 - DNA, 20 bp, synthetic construct
  source 1..20: mol_type = other DNA
tctggctttcccaataaacc

SEQ ID NO: 1561 - DNA, 20 bp, synthetic construct
  source 1..20: mol_type = other DNA
aacaacaatcatgtactttt

SEQ ID NO: 1562 - DNA, 20 bp, synthetic construct
  source 1..20: mol_type = other DNA
acaagccctttataacaggt

SEQ ID NO: 1563 - DNA, 20 bp, synthetic construct
  source 1..20: mol_type = other DNA
ttgcccaacaccaggcagag

SEQ ID NO: 1564 - DNA, 20 bp, synthetic construct
  source 1..20: mol_type = other DNA
gtttcaaaactacatttaca

SEQ ID NO: 1565 - DNA, 20 bp, synthetic construct
  source 1..20: mol_type = other DNA
tcttccaattttgtaaattt

SEQ ID NO: 1566 - DNA, 20 bp, synthetic construct
  source 1..20: mol_type = other DNA
caccatcaacagatctgcat

SEQ ID NO: 1567 - DNA, 20 bp, synthetic construct
  source 1..20: mol_type = other DNA
aggcctagccccaaacagga

SEQ ID NO: 1568 - DNA, 20 bp, synthetic construct
  source 1..20: mol_type = other DNA
cagatcttaaaaaaggatgc

SEQ ID NO: 1569 - DNA, 20 bp, synthetic construct
  source 1..20: mol_type = other DNA
atcaggaaaagatgatggcc

SEQ ID NO: 1570 - DNA, 20 bp, synthetic construct
  source 1..20: mol_type = other DNA
agagcacccacttagctttc

SEQ ID NO: 1571 - DNA, 20 bp, synthetic construct
  source 1..20: mol_type = other DNA
aacctattccctgttgtaaa

SEQ ID NO: 1572 - DNA, 20 bp, synthetic construct
  source 1..20: mol_type = other DNA
acggcaaatcaaagagctgg

SEQ ID NO: 1573 - DNA, 20 bp, synthetic construct
  source 1..20: mol_type = other DNA
acagaaacctaaaattaaga

SEQ ID NO: 1574 - DNA, 20 bp, synthetic construct
  source 1..20: mol_type = other DNA
acccccaaccccccttaccc

SEQ ID NO: 1575 - DNA, 20 bp, synthetic construct
  source 1..20: mol_type = other DNA
cctttaaaccacattgaaac

SEQ ID NO: 1576 - DNA, 20 bp, synthetic construct
  source 1..20: mol_type = other DNA
gcaggaatatcacacaagtt

SEQ ID NO: 1577 - DNA, 20 bp, synthetic construct
  source 1..20: mol_type = other DNA
aactatgaaataccctttct

SEQ ID NO: 1578 - DNA, 20 bp, synthetic construct
  source 1..20: mol_type = other DNA
aaggaactattctagctatt

SEQ ID NO: 1579 - DNA, 20 bp, synthetic construct
  source 1..20: mol_type = other DNA
tagaaccacaaaaattatga

SEQ ID NO: 1580 - DNA, 20 bp, synthetic construct
  source 1..20: mol_type = other DNA
accgaagaatttctacccct

SEQ ID NO: 1581 - DNA, 20 bp, synthetic construct
  source 1..20: mol_type = other DNA
aacagaaatcaaatcatccc

SEQ ID NO: 1582 - DNA, 20 bp, synthetic construct
  source 1..20: mol_type = other DNA
aacaaaaataaattttggca

SEQ ID NO: 1583 - DNA, 20 bp, synthetic construct
  source 1..20: mol_type = other DNA
atgtgttcttaaattctcta

SEQ ID NO: 1584 - DNA, 20 bp, synthetic construct
  source 1..20: mol_type = other DNA
tgtactcctcaaagtgagtg

SEQ ID NO: 1585 - DNA, 20 bp, synthetic construct
  source 1..20: mol_type = other DNA
acagtattctcaaatcgcag

SEQ ID NO: 1586 - DNA, 20 bp, synthetic construct
  source 1..20: mol_type = other DNA
ctgtccagtttccactgtcc

SEQ ID NO: 1587 - DNA, 20 bp, synthetic construct
  source 1..20: mol_type = other DNA
cagcaaacaaactaaaggga

SEQ ID NO: 1588 - DNA, 20 bp, synthetic construct
  source 1..20: mol_type = other DNA
gccctcaacccaagttctgg

SEQ ID NO: 1589 - DNA, 20 bp, synthetic construct
  source 1..20: mol_type = other DNA
tatgaattcttccatttttt

SEQ ID NO: 1590 - DNA, 20 bp, synthetic construct
  source 1..20: mol_type = other DNA
aacattattcaaagaaatgt

SEQ ID NO: 1591 - DNA, 20 bp, synthetic construct
  source 1..20: mol_type = other DNA
aggcagaacatttaacatcg

SEQ ID NO: 1592 - DNA, 20 bp, synthetic construct
  source 1..20: mol_type = other DNA
tctgtgtttatttaggtttc

SEQ ID NO: 1593 - DNA, 20 bp, synthetic construct
  source 1..20: mol_type = other DNA
actgcatttcaaaacctaca

SEQ ID NO: 1594 - DNA, 20 bp, synthetic construct
  source 1..20: mol_type = other DNA
ttgaagttttaaagtacatg

SEQ ID NO: 1595 - DNA, 20 bp, synthetic construct
  source 1..20: mol_type = other DNA
atgtttaaaatatgcatgcc

SEQ ID NO: 1596 - DNA, 20 bp, synthetic construct
  source 1..20: mol_type = other DNA
tttctcagaatataactgta

SEQ ID NO: 1597 - DNA, 20 bp, synthetic construct
  source 1..20: mol_type = other DNA
gtgtaatttcaaaatagggt

SEQ ID NO: 1598 - DNA, 20 bp, synthetic construct
  source 1..20: mol_type = other DNA
agctttcaaatttatccact

SEQ ID NO: 1599 - DNA, 20 bp, synthetic construct
  source 1..20: mol_type = other DNA
acttagccaatttaactgca

SEQ ID NO: 1600 - DNA, 20 bp, synthetic construct
  source 1..20: mol_type = other DNA
tctttaaaactattagtcac

SEQ ID NO: 1601 - DNA, 20 bp, synthetic construct
  source 1..20: mol_type = other DNA
ctaatctatcaaacctaatc

SEQ ID NO: 1602 - DNA, 20 bp, synthetic construct
  source 1..20: mol_type = other DNA
tcagttaaaatacctgatga

SEQ ID NO: 1603 - DNA, 20 bp, synthetic construct
  source 1..20: mol_type = other DNA
ggttaatatttttatggtat

SEQ ID NO: 1604 - DNA, 20 bp, synthetic construct
  source 1..20: mol_type = other DNA
gttataatttaaaaagtgtt

SEQ ID NO: 1605 - DNA, 20 bp, synthetic construct
  source 1..20: mol_type = other DNA
ccgttttatttttaaactcg

SEQ ID NO: 1606 - DNA, 20 bp, synthetic construct
  source 1..20: mol_type = other DNA
gcttcattttaaaagattgt

SEQ ID NO: 1607 - DNA, 20 bp, synthetic construct
  source 1..20: mol_type = other DNA
ccacataaaatatcgaatca

SEQ ID NO: 1608 - DNA, 20 bp, synthetic construct
  source 1..20: mol_type = other DNA
cagggctgtatttaattctg

SEQ ID NO: 1609 - DNA, 20 bp, synthetic construct
  source 1..20: mol_type = other DNA
gttctcaatccttaatgatt

SEQ ID NO: 1610 - DNA, 20 bp, synthetic construct
  source 1..20: mol_type = other DNA
gacatattttaaaacatgga

SEQ ID NO: 1611 - DNA, 20 bp, synthetic construct
  source 1..20: mol_type = other DNA
aaccaatcctaaacccgttt

SEQ ID NO: 1612 - DNA, 20 bp, synthetic construct
  source 1..20: mol_type = other DNA
aggcctgacttttatatgca

SEQ ID NO: 1613 - DNA, 20 bp, synthetic construct
  source 1..20: mol_type = other DNA
tgttttcaaatcctagatgg

SEQ ID NO: 1614 - DNA, 20 bp, synthetic construct
  source 1..20: mol_type = other DNA
ttttaaataagatctttggg

SEQ ID NO: 1615 - DNA, 20 bp, synthetic construct
  source 1..20: mol_type = other DNA
aacctcttttcacacctgcc

SEQ ID NO: 1616 - DNA, 20 bp, synthetic construct
  source 1..20: mol_type = other DNA
agtagagagatttagtgatc

SEQ ID NO: 1617 - DNA, 20 bp, synthetic construct
  source 1..20: mol_type = other DNA
ggagaaaaccatctcttctt

SEQ ID NO: 1618 - DNA, 20 bp, synthetic construct
  source 1..20: mol_type = other DNA
gcattaaaaaacggaaccct

SEQ ID NO: 1619 - DNA, 20 bp, synthetic construct
  source 1..20: mol_type = other DNA
ttcccctttcctcccacagc

SEQ ID NO: 1620 - DNA, 20 bp, synthetic construct
  source 1..20: mol_type = other DNA
tgatttatttttcagctgtg

SEQ ID NO: 1621 - DNA, 20 bp, synthetic construct
  source 1..20: mol_type = other DNA
aatgcacccctcaaatccag

SEQ ID NO: 1622 - DNA, 20 bp, synthetic construct
  source 1..20: mol_type = other DNA
agtcaaccaaaaaatagtag

SEQ ID NO: 1623 - DNA, 20 bp, synthetic construct
  source 1..20: mol_type = other DNA
agagaggtacaaagacccac

SEQ ID NO: 1624 - DNA, 20 bp, synthetic construct
  source 1..20: mol_type = other DNA
aacaacataatattcagtgc

SEQ ID NO: 1625 - DNA, 20 bp, synthetic construct
  source 1..20: mol_type = other DNA
tgagtgtaagaatctctgtg

SEQ ID NO: 1626 - DNA, 20 bp, synthetic construct
  source 1..20: mol_type = other DNA
acactatcccagacatacaa

SEQ ID NO: 1627 - DNA, 20 bp, synthetic construct
  source 1..20: mol_type = other DNA
ccacttagtcaataactact

SEQ ID NO: 1628 - DNA, 20 bp, synthetic construct
  source 1..20: mol_type = other DNA
tgccagcaagcccatgtgct

SEQ ID NO: 1629 - DNA, 20 bp, synthetic construct
  source 1..20: mol_type = other DNA
gagcagtaccacagataacc

SEQ ID NO: 1630 - DNA, 20 bp, synthetic construct
  source 1..20: mol_type = other DNA
tgctcagttaaaatctgaaa

SEQ ID NO: 1631 - DNA, 20 bp, synthetic construct
  source 1..20: mol_type = other DNA
ctctagtttccatagcttcc

SEQ ID NO: 1632 - DNA, 20 bp, synthetic construct
  source 1..20: mol_type = other DNA
ttccaaatacacctagaatg

SEQ ID NO: 1633 - DNA, 20 bp, synthetic construct
  source 1..20: mol_type = other DNA
cttgcctcccaccaggagac

SEQ ID NO: 1634 - DNA, 20 bp, synthetic construct
  source 1..20: mol_type = other DNA
tgatgtcatcttcaactgga

SEQ ID NO: 1635 - DNA, 20 bp, synthetic construct
  source 1..20: mol_type = other DNA
ggtttttttcccttctttgg

SEQ ID NO: 1636 - DNA, 20 bp, synthetic construct
  source 1..20: mol_type = other DNA
gattcttctttaatcacttc

SEQ ID NO: 1637 - DNA, 20 bp, synthetic construct
  source 1..20: mol_type = other DNA
ctcatcatcttctcaatttc

SEQ ID NO: 1638 - DNA, 20 bp, synthetic construct
  source 1..20: mol_type = other DNA
cacaaacaacaatcatgtac

SEQ ID NO: 1639 - DNA, 20 bp, synthetic construct
  source 1..20: mol_type = other DNA
ctacaagccctttataacag

SEQ ID NO: 1640 - DNA, 20 bp, synthetic construct
  source 1..20: mol_type = other DNA
tattcttgcccaacaccagg

SEQ ID NO: 1641 - DNA, 20 bp, synthetic construct
  source 1..20: mol_type = other DNA
ggtttcaaaactacatttac

SEQ ID NO: 1642 - DNA, 20 bp, synthetic construct
  source 1..20: mol_type = other DNA
tctcaggtacaaactttaca

SEQ ID NO: 1643 - DNA, 20 bp, synthetic construct
  source 1..20: mol_type = other DNA
ttcaccatcaacagatctgc

SEQ ID NO: 1644 - DNA, 20 bp, synthetic construct
  source 1..20: mol_type = other DNA
agacagtttcaagaaggcct

SEQ ID NO: 1645 - DNA, 20 bp, synthetic construct
  source 1..20: mol_type = other DNA
tcagatcttaaaaaaggatg

SEQ ID NO: 1646 - DNA, 20 bp, synthetic construct
  source 1..20: mol_type = other DNA
aagatagtaaaaaggccagg

SEQ ID NO: 1647 - DNA, 20 bp, synthetic construct
  source 1..20: mol_type = other DNA
atcgaaccccagtaatgaca

SEQ ID NO: 1648 - DNA, 20 bp, synthetic construct
  source 1..20: mol_type = other DNA
ttgtgtaaacctattccctg

SEQ ID NO: 1649 - DNA, 20 bp, synthetic construct
  source 1..20: mol_type = other DNA
acacggcaaatcaaagagct

SEQ ID NO: 1650 - DNA, 20 bp, synthetic construct
  source 1..20: mol_type = other DNA
aaggttagaacagaaaccta

SEQ ID NO: 1651 - DNA, 20 bp, synthetic construct
  source 1..20: mol_type = other DNA
cacccccaaccccccttacc

SEQ ID NO: 1652 - DNA, 20 bp, synthetic construct
  source 1..20: mol_type = other DNA
ccctttaaaccacattgaaa

SEQ ID NO: 1653 - DNA, 20 bp, synthetic construct
  source 1..20: mol_type = other DNA
ccccaaacctttcccacaat

SEQ ID NO: 1654 - DNA, 20 bp, synthetic construct
  source 1..20: mol_type = other DNA
atgatatttcggatctctgg

SEQ ID NO: 1655 - DNA, 20 bp, synthetic construct
  source 1..20: mol_type = other DNA
gtcaaggaactattctagct

SEQ ID NO: 1656 - DNA, 20 bp, synthetic construct
  source 1..20: mol_type = other DNA
attcctatacctgaaataga

SEQ ID NO: 1657 - DNA, 20 bp, synthetic construct
  source 1..20: mol_type = other DNA
caccgaagaatttctacccc

SEQ ID NO: 1658 - DNA, 20 bp, synthetic construct
  source 1..20: mol_type = other DNA
ctcacaattccaagttagaa

SEQ ID NO: 1659 - DNA, 20 bp, synthetic construct
  source 1..20: mol_type = other DNA
agtagtcacagatgttaaag

SEQ ID NO: 1660 - DNA, 20 bp, synthetic construct
  source 1..20: mol_type = other DNA
gatgtgttcttaaattctct

SEQ ID NO: 1661 - DNA, 20 bp, synthetic construct
  source 1..20: mol_type = other DNA
acctgtactcctcaaagtga

SEQ ID NO: 1662 - DNA, 20 bp, synthetic construct
  source 1..20: mol_type = other DNA
aacagtattctcaaatcgca

SEQ ID NO: 1663 - DNA, 20 bp, synthetic construct
  source 1..20: mol_type = other DNA
cttaatatccccacagctgt

SEQ ID NO: 1664 - DNA, 20 bp, synthetic construct
  source 1..20: mol_type = other DNA
ttggccatccagacagcaaa

SEQ ID NO: 1665 - DNA, 20 bp, synthetic construct
  source 1..20: mol_type = other DNA
tgccctcaacccaagttctg

SEQ ID NO: 1666 - DNA, 20 bp, synthetic construct
  source 1..20: mol_type = other DNA
atatgaattcttccattttt

SEQ ID NO: 1667 - DNA, 20 bp, synthetic construct
  source 1..20: mol_type = other DNA
cgttataaaatatattacta

SEQ ID NO: 1668 - DNA, 20 bp, synthetic construct
  source 1..20: mol_type = other DNA
gcaagatgaatttatcctcc

SEQ ID NO: 1669 - DNA, 20 bp, synthetic construct
  source 1..20: mol_type = other DNA
cacaacttattttaatgtca

SEQ ID NO: 1670 - DNA, 20 bp, synthetic construct
  source 1..20: mol_type = other DNA
tgagtattttaaactcttct

SEQ ID NO: 1671 - DNA, 20 bp, synthetic construct
  source 1..20: mol_type = other DNA
attccattattttagaaagc

SEQ ID NO: 1672 - DNA, 20 bp, synthetic construct
  source 1..20: mol_type = other DNA
acttgcaaaatttcaagttt

SEQ ID NO: 1673 - DNA, 20 bp, synthetic construct
  source 1..20: mol_type = other DNA
agcaagttaatttatggcca

SEQ ID NO: 1674 - DNA, 20 bp, synthetic construct
  source 1..20: mol_type = other DNA
gattgaatcatttacctcgc

SEQ ID NO: 1675 - DNA, 20 bp, synthetic construct
  source 1..20: mol_type = other DNA
atctgctttctttattccct

SEQ ID NO: 1676 - DNA, 20 bp, synthetic construct
  source 1..20: mol_type = other DNA
atctctgttatttaacactg

SEQ ID NO: 1677 - DNA, 20 bp, synthetic construct
  source 1..20: mol_type = other DNA
ttctttaaaactattagtca

SEQ ID NO: 1678 - DNA, 20 bp, synthetic construct
  source 1..20: mol_type = other DNA
gacctcaaaaccaaattagg

SEQ ID NO: 1679 - DNA, 20 bp, synthetic construct
  source 1..20: mol_type = other DNA
tctgaaattcaaaatcagtg

SEQ ID NO: 1680 - DNA, 20 bp, synthetic construct
  source 1..20: mol_type = other DNA
ccactggaaatttaacatga

SEQ ID NO: 1681 - DNA, 20 bp, synthetic construct
  source 1..20: mol_type = other DNA
tgtatcacccattaactgac

SEQ ID NO: 1682 - DNA, 20 bp, synthetic construct
  source 1..20: mol_type = other DNA
gactaaaaaatatacatctc

SEQ ID NO: 1683 - DNA, 20 bp, synthetic construct
  source 1..20: mol_type = other DNA
ggtctatttctttacagcac

SEQ ID NO: 1684 - DNA, 20 bp, synthetic construct
  source 1..20: mol_type = other DNA
ttcttctgtatttaattctt

SEQ ID NO: 1685 - DNA, 20 bp, synthetic construct
  source 1..20: mol_type = other DNA
actgagtttcaaagcaaaga

SEQ ID NO: 1686 - DNA, 20 bp, synthetic construct
  source 1..20: mol_type = other DNA
atccgattttaaaacaaaca

SEQ ID NO: 1687 - DNA, 20 bp, synthetic construct
  source 1..20: mol_type = other DNA
agacatattttaaaacatgg

SEQ ID NO: 1688 - DNA, 20 bp, synthetic construct
  source 1..20: mol_type = other DNA
taaccaatcctaaacccgtt

SEQ ID NO: 1689 - DNA, 20 bp, synthetic construct
  source 1..20: mol_type = other DNA
attagctaattcctagaggc

SEQ ID NO: 1690 - DNA, 20 bp, synthetic construct
  source 1..20: mol_type = other DNA
tgaatgttttcaaatcctag

SEQ ID NO: 1691 - DNA, 20 bp, synthetic construct
  source 1..20: mol_type = other DNA
ccatttattttaaaaatcct

SEQ ID NO: 1692 - DNA, 20 bp, synthetic construct
  source 1..20: mol_type = other DNA
catttctaaacaaaacctct

SEQ ID NO: 1693 - DNA, 20 bp, synthetic construct
  source 1..20: mol_type = other DNA
cagtagagagatttagtgat

SEQ ID NO: 1694 - DNA, 20 bp, synthetic construct
  source 1..20: mol_type = other DNA
tggagaaaaccatctcttct

SEQ ID NO: 1695 - DNA, 20 bp, synthetic construct
  source 1..20: mol_type = other DNA
gtgaagcattaaaaaacgga

SEQ ID NO: 1696 - DNA, 20 bp, synthetic construct
  source 1..20: mol_type = other DNA
ctggcattcccctttcctcc

SEQ ID NO: 1697 - DNA, 20 bp, synthetic construct
  source 1..20: mol_type = other DNA
ttgatttatttttcagctgt

SEQ ID NO: 1698 - DNA, 20 bp, synthetic construct
  source 1..20: mol_type = other DNA
ccaatgcacccctcaaatcc

SEQ ID NO: 1699 - DNA, 20 bp, synthetic construct
  source 1..20: mol_type = other DNA
ccgatgactcacagctcaca

SEQ ID NO: 1700 - DNA, 20 bp, synthetic construct
  source 1..20: mol_type = other DNA
gagagcatttttctcctttt

SEQ ID NO: 1701 - DNA, 20 bp, synthetic construct
  source 1..20: mol_type = other DNA
gaacaacataatattcagtg

SEQ ID NO: 1702 - DNA, 20 bp, synthetic construct
  source 1..20: mol_type = other DNA
tcattaataaaaacagtcaa

SEQ ID NO: 1703 - DNA, 20 bp, synthetic construct
  source 1..20: mol_type = other DNA
tgacactatcccagacatac

SEQ ID NO: 1704 - DNA, 20 bp, synthetic construct
  source 1..20: mol_type = other DNA
caccacttagtcaataacta

SEQ ID NO: 1705 - DNA, 20 bp, synthetic construct
  source 1..20: mol_type = other DNA
ccaccctcctccactctttc

SEQ ID NO: 1706 - DNA, 20 bp, synthetic construct
  source 1..20: mol_type = other DNA
gggagcagtaccacagataa

SEQ ID NO: 1707 - DNA, 20 bp, synthetic construct
  source 1..20: mol_type = other DNA
gtgctcagttaaaatctgaa

SEQ ID NO: 1708 - DNA, 20 bp, synthetic construct
  source 1..20: mol_type = other DNA
ccctctagtttccatagctt

SEQ ID NO: 1709 - DNA, 20 bp, synthetic construct
  source 1..20: mol_type = other DNA
cttttccaaatacacctaga

SEQ ID NO: 1710 - DNA, 20 bp, synthetic construct
  source 1..20: mol_type = other DNA
ttggttaagacctagtttct

SEQ ID NO: 1711 - DNA, 20 bp, synthetic construct
  source 1..20: mol_type = other DNA
tggatgtgaaacagagacgg

SEQ ID NO: 1712 - DNA, 20 bp, synthetic construct
  source 1..20: mol_type = other DNA
ataaggtttttttcccttct

SEQ ID NO: 1713 - DNA, 20 bp, synthetic construct
  source 1..20: mol_type = other DNA
agattcttctttaatcactt

SEQ ID NO: 1714 - DNA, 20 bp, synthetic construct
  source 1..20: mol_type = other DNA
gagatggtactttagaaggc

SEQ ID NO: 1715 - DNA, 20 bp, synthetic construct
  source 1..20: mol_type = other DNA
acacaaacaacaatcatgta

SEQ ID NO: 1716 - DNA, 20 bp, synthetic construct
  source 1..20: mol_type = other DNA
tgtctacaagccctttataa

SEQ ID NO: 1717 - DNA, 20 bp, synthetic construct
  source 1..20: mol_type = other DNA
tgcttattcttgcccaacac

SEQ ID NO: 1718 - DNA, 20 bp, synthetic construct
  source 1..20: mol_type = other DNA
tggtttcaaaactacattta

SEQ ID NO: 1719 - DNA, 20 bp, synthetic construct
  source 1..20: mol_type = other DNA
ggctatttttataatgtgaa

SEQ ID NO: 1720 - DNA, 20 bp, synthetic construct
  source 1..20: mol_type = other DNA
acagtaattaaaagaattca

SEQ ID NO: 1721 - DNA, 20 bp, synthetic construct
  source 1..20: mol_type = other DNA
cagaagttaatacttgagga

SEQ ID NO: 1722 - DNA, 20 bp, synthetic construct
  source 1..20: mol_type = other DNA
gcaaaatatcagatcttaaa

SEQ ID NO: 1723 - DNA, 20 bp, synthetic construct
  source 1..20: mol_type = other DNA
ggacagcaaataagatagta

SEQ ID NO: 1724 - DNA, 20 bp, synthetic construct
  source 1..20: mol_type = other DNA
ccagtcaatcgaaccccagt

SEQ ID NO: 1725 - DNA, 20 bp, synthetic construct
  source 1..20: mol_type = other DNA
tttgtgtaaacctattccct

SEQ ID NO: 1726 - DNA, 20 bp, synthetic construct
  source 1..20: mol_type = other DNA
gcagacatccccaactgaga

SEQ ID NO: 1727 - DNA, 20 bp, synthetic construct
  source 1..20: mol_type = other DNA
ctcctgcgacacacctgctg

SEQ ID NO: 1728 - DNA, 20 bp, synthetic construct
  source 1..20: mol_type = other DNA
attggttttcctaacactgc

SEQ ID NO: 1729 - DNA, 20 bp, synthetic construct
  source 1..20: mol_type = other DNA
tccctttaaaccacattgaa

SEQ ID NO: 1730 - DNA, 20 bp, synthetic construct
  source 1..20: mol_type = other DNA
cccccaaacctttcccacaa

SEQ ID NO: 1731 - DNA, 20 bp, synthetic construct
  source 1..20: mol_type = other DNA
cccacaaatgatatttcgga

SEQ ID NO: 1732 - DNA, 20 bp, synthetic construct
  source 1..20: mol_type = other DNA
ggtaatgaaattcgaggaaa

SEQ ID NO: 1733 - DNA, 20 bp, synthetic construct
  source 1..20: mol_type = other DNA
ttttataattcctatacctg

SEQ ID NO: 1734 - DNA, 20 bp, synthetic construct
  source 1..20: mol_type = other DNA
ggcaccgaagaatttctacc

SEQ ID NO: 1735 - DNA, 20 bp, synthetic construct
  source 1..20: mol_type = other DNA
gctcacaattccaagttaga

SEQ ID NO: 1736 - DNA, 20 bp, synthetic construct
  source 1..20: mol_type = other DNA
cttagtagtcacagatgtta

SEQ ID NO: 1737 - DNA, 20 bp, synthetic construct
  source 1..20: mol_type = other DNA
tatatttattacttgatgtg

SEQ ID NO: 1738 - DNA, 20 bp, synthetic construct
  source 1..20: mol_type = other DNA
attttttaaaacattacctg

SEQ ID NO: 1739 - DNA, 20 bp, synthetic construct
  source 1..20: mol_type = other DNA
agaagtactttcagcatagg

SEQ ID NO: 1740 - DNA, 20 bp, synthetic construct
  source 1..20: mol_type = other DNA
gcttaatatccccacagctg

SEQ ID NO: 1741 - DNA, 20 bp, synthetic construct
  source 1..20: mol_type = other DNA
ttggccacagaaaaggagac

SEQ ID NO: 1742 - DNA, 20 bp, synthetic construct
  source 1..20: mol_type = other DNA
tggtagtgccctcaacccaa

SEQ ID NO: 1743 - DNA, 20 bp, synthetic construct
  source 1..20: mol_type = other DNA
ccacgattagaaaatagaat

SEQ ID NO: 1744 - DNA, 20 bp, synthetic construct
  source 1..20: mol_type = other DNA
tcaaacaaaatataatgctt

SEQ ID NO: 1745 - DNA, 20 bp, synthetic construct
  source 1..20: mol_type = other DNA
ctacacaaaaccaatcactt

SEQ ID NO: 1746 - DNA, 20 bp, synthetic construct
  source 1..20: mol_type = other DNA
cgccttaatttttattatag

SEQ ID NO: 1747 - DNA, 20 bp, synthetic construct
  source 1..20: mol_type = other DNA
ccatttagaatatagctgtt

SEQ ID NO: 1748 - DNA, 20 bp, synthetic construct
  source 1..20: mol_type = other DNA
attctcatccattatacttt

SEQ ID NO: 1749 - DNA, 20 bp, synthetic construct
  source 1..20: mol_type = other DNA
ttaccaaaaaccatttgtgt

SEQ ID NO: 1750 - DNA, 20 bp, synthetic construct
  source 1..20: mol_type = other DNA
tccttctttcaaagttcacc

SEQ ID NO: 1751 - DNA, 20 bp, synthetic construct
  source 1..20: mol_type = other DNA
ctgccactattttatgtctg

SEQ ID NO: 1752 - DNA, 20 bp, synthetic construct
  source 1..20: mol_type = other DNA
cccaggttcccttatcatct

SEQ ID NO: 1753 - DNA, 20 bp, synthetic construct
  source 1..20: mol_type = other DNA
ttctgcaaataattccgtca

SEQ ID NO: 1754 - DNA, 20 bp, synthetic construct
  source 1..20: mol_type = other DNA
ccatcatttctttaaaacta

SEQ ID NO: 1755 - DNA, 20 bp, synthetic construct
  source 1..20: mol_type = other DNA
aagtacatacaaatacatat

SEQ ID NO: 1756 - DNA, 20 bp, synthetic construct
  source 1..20: mol_type = other DNA
cctatcaaagccacaacttc

SEQ ID NO: 1757 - DNA, 20 bp, synthetic construct
  source 1..20: mol_type = other DNA
ttgtataccatttatgtttc

SEQ ID NO: 1758 - DNA, 20 bp, synthetic construct
  source 1..20: mol_type = other DNA
ccactcaaacctttcaatgc

SEQ ID NO: 1759 - DNA, 20 bp, synthetic construct
  source 1..20: mol_type = other DNA
gagctcaaacccaagtctgt

SEQ ID NO: 1760 - DNA, 20 bp, synthetic construct
  source 1..20: mol_type = other DNA
accctatttccttaatgtaa

SEQ ID NO: 1761 - DNA, 20 bp, synthetic construct
  source 1..20: mol_type = other DNA
ctccttcacccttaaggcta

SEQ ID NO: 1762 - DNA, 20 bp, synthetic construct
  source 1..20: mol_type = other DNA
atcgagtccttttaaacaaa

SEQ ID NO: 1763 - DNA, 20 bp, synthetic construct
  source 1..20: mol_type = other DNA
acaactcgccattaacacta

SEQ ID NO: 1764 - DNA, 20 bp, synthetic construct
  source 1..20: mol_type = other DNA
agctaataagacatatttta

SEQ ID NO: 1765 - DNA, 20 bp, synthetic construct
  source 1..20: mol_type = other DNA
ctaaccaatcctaaacccgt

SEQ ID NO: 1766 - DNA, 20 bp, synthetic construct
  source 1..20: mol_type = other DNA
gattagctaattcctagagg

SEQ ID NO: 1767 - DNA, 20 bp, synthetic construct
  source 1..20: mol_type = other DNA
ttgaatgttttcaaatccta

SEQ ID NO: 1768 - DNA, 20 bp, synthetic construct
  source 1..20: mol_type = other DNA
gccatttattttaaaaatcc

SEQ ID NO: 1769 - DNA, 20 bp, synthetic construct
  source 1..20: mol_type = other DNA
gcatttctaaacaaaacctc

SEQ ID NO: 1770 - DNA, 20 bp, synthetic construct
  source 1..20: mol_type = other DNA
tgaggaagcccttcccggca

SEQ ID NO: 1771 - DNA, 20 bp, synthetic construct
  source 1..20: mol_type = other DNA
ttggagaaaaccatctcttc

SEQ ID NO: 1772 - DNA, 20 bp, synthetic construct
  source 1..20: mol_type = other DNA
ggaaagtataaaagtgaagc

SEQ ID NO: 1773 - DNA, 20 bp, synthetic construct
  source 1..20: mol_type = other DNA
gcacgcagtaacaatggaca

SEQ ID NO: 1774 - DNA, 20 bp, synthetic construct
  source 1..20: mol_type = other DNA
ctttgatttatttttcagct

SEQ ID NO: 1775 - DNA, 20 bp, synthetic construct
  source 1..20: mol_type = other DNA
cccttgtttctgcattggtt

SEQ ID NO: 1776 - DNA, 20 bp, synthetic construct
  source 1..20: mol_type = other DNA
tgttaccaccgatgactcac

SEQ ID NO: 1777 - DNA, 20 bp, synthetic construct
  source 1..20: mol_type = other DNA
gcacatacagtttaaaggag

SEQ ID NO: 1778 - DNA, 20 bp, synthetic construct
  source 1..20: mol_type = other DNA
ggtccctgttcctagggagg

SEQ ID NO: 1779 - DNA, 20 bp, synthetic construct
  source 1..20: mol_type = other DNA
gcaatgtttaaaaatcatta

SEQ ID NO: 1780 - DNA, 20 bp, synthetic construct
  source 1..20: mol_type = other DNA
ttcatgacactatcccagac

SEQ ID NO: 1781 - DNA, 20 bp, synthetic construct
  source 1..20: mol_type = other DNA
cctttcaccacttagtcaat

SEQ ID NO: 1782 - DNA, 20 bp, synthetic construct
  source 1..20: mol_type = other DNA
gcctcccaccctcctccact

SEQ ID NO: 1783 - DNA, 20 bp, synthetic construct
  source 1..20: mol_type = other DNA
atgaaaataaactcatggga

SEQ ID NO: 1784 - DNA, 20 bp, synthetic construct
  source 1..20: mol_type = other DNA
gtctaaaagacttcctagca

SEQ ID NO: 1785 - DNA, 20 bp, synthetic construct
  source 1..20: mol_type = other DNA
tctatttaaaataacaaccc

SEQ ID NO: 1786 - DNA, 20 bp, synthetic construct
  source 1..20: mol_type = other DNA
ttccttttccaaatacacct

SEQ ID NO: 1787 - DNA, 20 bp, synthetic construct
  source 1..20: mol_type = other DNA
tagaagagtatctattggtt

SEQ ID NO: 1788 - DNA, 20 bp, synthetic construct
  source 1..20: mol_type = other DNA
catctcaaaacatgctgtca

SEQ ID NO: 1789 - DNA, 20 bp, synthetic construct
  source 1..20: mol_type = other DNA
gagaagtaaaataaggtttt

SEQ ID NO: 1790 - DNA, 20 bp, synthetic construct
  source 1..20: mol_type = other DNA
gagattcttctttaatcact

SEQ ID NO: 1791 - DNA, 20 bp, synthetic construct
  source 1..20: mol_type = other DNA
ggagattttacttaattttt

SEQ ID NO: 1792 - DNA, 20 bp, synthetic construct
  source 1..20: mol_type = other DNA
tacacaaacaacaatcatgt

SEQ ID NO: 1793 - DNA, 20 bp, synthetic construct
  source 1..20: mol_type = other DNA
ctcattaagaaatgtctaca

SEQ ID NO: 1794 - DNA, 20 bp, synthetic construct
  source 1..20: mol_type = other DNA
gactctctaccagagttgcg

SEQ ID NO: 1795 - DNA, 20 bp, synthetic construct
  source 1..20: mol_type = other DNA
atttggtttcaaaactacat

SEQ ID NO: 1796 - DNA, 20 bp, synthetic construct
  source 1..20: mol_type = other DNA
gggctatttttataatgtga

SEQ ID NO: 1797 - DNA, 20 bp, synthetic construct
  source 1..20: mol_type = other DNA
gttcagacaaacagtaatta

SEQ ID NO: 1798 - DNA, 20 bp, synthetic construct
  source 1..20: mol_type = other DNA
acataatttgaatcctagga

SEQ ID NO: 1799 - DNA, 20 bp, synthetic construct
  source 1..20: mol_type = other DNA
tagcaaaatatcagatctta

SEQ ID NO: 1800 - DNA, 20 bp, synthetic construct
  source 1..20: mol_type = other DNA
ctggacagcaaataagatag

SEQ ID NO: 1801 - DNA, 20 bp, synthetic construct
  source 1..20: mol_type = other DNA
tgttagaaccagtcaatcga

SEQ ID NO: 1802 - DNA, 20 bp, synthetic construct
  source 1..20: mol_type = other DNA
tagtccagccctgtggacaa

SEQ ID NO: 1803 - DNA, 20 bp, synthetic construct
  source 1..20: mol_type = other DNA
tgcagacatccccaactgag

SEQ ID NO: 1804 - DNA, 20 bp, synthetic construct
  source 1..20: mol_type = other DNA
catatgcaccagtctcctgc

SEQ ID NO: 1805 - DNA, 20 bp, synthetic construct
  source 1..20: mol_type = other DNA
tgcaataacctgattggttt

SEQ ID NO: 1806 - DNA, 20 bp, synthetic construct
  source 1..20: mol_type = other DNA
tcatccctttaaaccacatt

SEQ ID NO: 1807 - DNA, 20 bp, synthetic construct
  source 1..20: mol_type = other DNA
tcccccaaacctttcccaca

SEQ ID NO: 1808 - DNA, 20 bp, synthetic construct
  source 1..20: mol_type = other DNA
ttcaaaacccacaaatgata

SEQ ID NO: 1809 - DNA, 20 bp, synthetic construct
  source 1..20: mol_type = other DNA
agggtaatgaaattcgagga

SEQ ID NO: 1810 - DNA, 20 bp, synthetic construct
  source 1..20: mol_type = other DNA
tattttataattcctatacc

SEQ ID NO: 1811 - DNA, 20 bp, synthetic construct
  source 1..20: mol_type = other DNA
ggacatagtacagaggcaca

SEQ ID NO: 1812 - DNA, 20 bp, synthetic construct
  source 1..20: mol_type = other DNA
ggctcacaattccaagttag

SEQ ID NO: 1813 - DNA, 20 bp, synthetic construct
  source 1..20: mol_type = other DNA
aataggtttccttagtagtc

SEQ ID NO: 1814 - DNA, 20 bp, synthetic construct
  source 1..20: mol_type = other DNA
tgtatatttattacttgatg

SEQ ID NO: 1815 - DNA, 20 bp, synthetic construct
  source 1..20: mol_type = other DNA
gtgcaattttttaaaacatt

SEQ ID NO: 1816 - DNA, 20 bp, synthetic construct
  source 1..20: mol_type = other DNA
gcaatggcttaagagtttag

SEQ ID NO: 1817 - DNA, 20 bp, synthetic construct
  source 1..20: mol_type = other DNA
tgcttaatatccccacagct

SEQ ID NO: 1818 - DNA, 20 bp, synthetic construct
  source 1..20: mol_type = other DNA
aaggccttcagattggccac

SEQ ID NO: 1819 - DNA, 20 bp, synthetic construct
  source 1..20: mol_type = other DNA
tctggtagtgccctcaaccc

SEQ ID NO: 1820 - DNA, 20 bp, synthetic construct
  source 1..20: mol_type = other DNA
tagacacaccacgattagaa

SEQ ID NO: 1821 - DNA, 20 bp, synthetic construct
  source 1..20: mol_type = other DNA
actcaatatttttaaaaccc

SEQ ID NO: 1822 - DNA, 20 bp, synthetic construct
  source 1..20: mol_type = other DNA
gactgaattatttatagttg

SEQ ID NO: 1823 - DNA, 20 bp, synthetic construct
  source 1..20: mol_type = other DNA
atgcaattttaaattcatgt

SEQ ID NO: 1824 - DNA, 20 bp, synthetic construct
  source 1..20: mol_type = other DNA
gggaaaattccttagcatat

SEQ ID NO: 1825 - DNA, 20 bp, synthetic construct
  source 1..20: mol_type = other DNA
gctgagttccaaagcaaatt

SEQ ID NO: 1826 - DNA, 20 bp, synthetic construct
  source 1..20: mol_type = other DNA
atgacttaccaaaaaccatt

SEQ ID NO: 1827 - DNA, 20 bp, synthetic construct
  source 1..20: mol_type = other DNA
agggcttaaatttaactgaa

SEQ ID NO: 1828 - DNA, 20 bp, synthetic construct
  source 1..20: mol_type = other DNA
aacgaaattccttaaggaca

SEQ ID NO: 1829 - DNA, 20 bp, synthetic construct
  source 1..20: mol_type = other DNA
ttggttctattttataatag

SEQ ID NO: 1830 - DNA, 20 bp, synthetic construct
  source 1..20: mol_type = other DNA
agactactattttatcactg

SEQ ID NO: 1831 - DNA, 20 bp, synthetic construct
  source 1..20: mol_type = other DNA
tcacttaaacccaggtcagc

SEQ ID NO: 1832 - DNA, 20 bp, synthetic construct
  source 1..20: mol_type = other DNA
ttccccaaaatttagttgtg

SEQ ID NO: 1833 - DNA, 20 bp, synthetic construct
  source 1..20: mol_type = other DNA
cttcaactattttatttggc

SEQ ID NO: 1834 - DNA, 20 bp, synthetic construct
  source 1..20: mol_type = other DNA
agtagaatttaaaagtagaa

SEQ ID NO: 1835 - DNA, 20 bp, synthetic construct
  source 1..20: mol_type = other DNA
ggatttctaatttaatcttt

SEQ ID NO: 1836 - DNA, 20 bp, synthetic construct
  source 1..20: mol_type = other DNA
tagttctttcaaactccttt

SEQ ID NO: 1837 - DNA, 20 bp, synthetic construct
  source 1..20: mol_type = other DNA
gctataattcaaaatgctct

SEQ ID NO: 1838 - DNA, 20 bp, synthetic construct
  source 1..20: mol_type = other DNA
gcctaaacaatttattcatt

SEQ ID NO: 1839 - DNA, 20 bp, synthetic construct
  source 1..20: mol_type = other DNA
acccttctattttataaagc

SEQ ID NO: 1840 - DNA, 20 bp, synthetic construct
  source 1..20: mol_type = other DNA
tgcaagtttcaaaagaattc

SEQ ID NO: 1841 - DNA, 20 bp, synthetic construct
  source 1..20: mol_type = other DNA
aaggcatataccactgtacc

SEQ ID NO: 1842 - DNA, 20 bp, synthetic construct
  source 1..20: mol_type = other DNA
tctaaccaatcctaaacccg

SEQ ID NO: 1843 - DNA, 20 bp, synthetic construct
  source 1..20: mol_type = other DNA
agaggtatagtctctcctag

SEQ ID NO: 1844 - DNA, 20 bp, synthetic construct
  source 1..20: mol_type = other DNA
tgactattttcaactcaagc

SEQ ID NO: 1845 - DNA, 20 bp, synthetic construct
  source 1..20: mol_type = other DNA
tattattatgccatttattt

SEQ ID NO: 1846 - DNA, 20 bp, synthetic construct
  source 1..20: mol_type = other DNA
tcgcatttctaaacaaaacc

SEQ ID NO: 1847 - DNA, 20 bp, synthetic construct
  source 1..20: mol_type = other DNA
tttgaggaagcccttcccgg

SEQ ID NO: 1848 - DNA, 20 bp, synthetic construct
  source 1..20: mol_type = other DNA
gttttggagaaaaccatctc

SEQ ID NO: 1849 - DNA, 20 bp, synthetic construct
  source 1..20: mol_type = other DNA
ctaataaatttttacaaggg

SEQ ID NO: 1850 - DNA, 20 bp, synthetic construct
  source 1..20: mol_type = other DNA
aaggaggcttcctttggtgc

SEQ ID NO: 1851 - DNA, 20 bp, synthetic construct
  source 1..20: mol_type = other DNA
aggcctttgatttatttttc

SEQ ID NO: 1852 - DNA, 20 bp, synthetic construct
  source 1..20: mol_type = other DNA
gatggaagccaaaggctccc

SEQ ID NO: 1853 - DNA, 20 bp, synthetic construct
  source 1..20: mol_type = other DNA
aatgttaccaccgatgactc

SEQ ID NO: 1854 - DNA, 20 bp, synthetic construct
  source 1..20: mol_type = other DNA
tctgagagaatcaaaacata

SEQ ID NO: 1855 - DNA, 20 bp, synthetic construct
  source 1..20: mol_type = other DNA
ctcacttgccttccttttct

SEQ ID NO: 1856 - DNA, 20 bp, synthetic construct
  source 1..20: mol_type = other DNA
tgcaatgtttaaaaatcatt

SEQ ID NO: 1857 - DNA, 20 bp, synthetic construct
  source 1..20: mol_type = other DNA
aacattttttcatgacacta

SEQ ID NO: 1858 - DNA, 20 bp, synthetic construct
  source 1..20: mol_type = other DNA
tcctttcaccacttagtcaa

SEQ ID NO: 1859 - DNA, 20 bp, synthetic construct
  source 1..20: mol_type = other DNA
tctgtctttcatctctggat

SEQ ID NO: 1860 - DNA, 20 bp, synthetic construct
  source 1..20: mol_type = other DNA
ccaatgaaaataaactcatg

SEQ ID NO: 1861 - DNA, 20 bp, synthetic construct
  source 1..20: mol_type = other DNA
ccagagtctaaaagacttcc

SEQ ID NO: 1862 - DNA, 20 bp, synthetic construct
  source 1..20: mol_type = other DNA
ttctatttaaaataacaacc

SEQ ID NO: 1863 - DNA, 20 bp, synthetic construct
  source 1..20: mol_type = other DNA
gtatgggttccttttccaaa

SEQ ID NO: 1864 - DNA, 20 bp, synthetic construct
  source 1..20: mol_type = other DNA
agttttaataaaagttcaac

SEQ ID NO: 1865 - DNA, 20 bp, synthetic construct
  source 1..20: mol_type = other DNA
ccatctcaaaacatgctgtc

SEQ ID NO: 1866 - DNA, 20 bp, synthetic construct
  source 1..20: mol_type = other DNA
atgtactttttcccccttgg

SEQ ID NO: 1867 - DNA, 20 bp, synthetic construct
  source 1..20: mol_type = other DNA
tgggagattcttctttaatc

SEQ ID NO: 1868 - DNA, 20 bp, synthetic construct
  source 1..20: mol_type = other DNA
tggagattttacttaatttt

SEQ ID NO: 1869 - DNA, 20 bp, synthetic construct
  source 1..20: mol_type = other DNA
gataatatacacaaacaaca

SEQ ID NO: 1870 - DNA, 20 bp, synthetic construct
  source 1..20: mol_type = other DNA
tagactcattaagaaatgtc

SEQ ID NO: 1871 - DNA, 20 bp, synthetic construct
  source 1..20: mol_type = other DNA
agactctctaccagagttgc

SEQ ID NO: 1872 - DNA, 20 bp, synthetic construct
  source 1..20: mol_type = other DNA
tgtgtgacactatttggttt

SEQ ID NO: 1873 - DNA, 20 bp, synthetic construct
  source 1..20: mol_type = other DNA
ctgggctatttttataatgt

SEQ ID NO: 1874 - DNA, 20 bp, synthetic construct
  source 1..20: mol_type = other DNA
agacatgttcagacaaacag

SEQ ID NO: 1875 - DNA, 20 bp, synthetic construct
  source 1..20: mol_type = other DNA
acacataatttgaatcctag

SEQ ID NO: 1876 - DNA, 20 bp, synthetic construct
  source 1..20: mol_type = other DNA
actagcaaaatatcagatct

SEQ ID NO: 1877 - DNA, 20 bp, synthetic construct
  source 1..20: mol_type = other DNA
actttttttcttatagtact

SEQ ID NO: 1878 - DNA, 20 bp, synthetic construct
  source 1..20: mol_type = other DNA
tctgttagaaccagtcaatc

SEQ ID NO: 1879 - DNA, 20 bp, synthetic construct
  source 1..20: mol_type = other DNA
tcagactgcccatgttggcc

SEQ ID NO: 1880 - DNA, 20 bp, synthetic construct
  source 1..20: mol_type = other DNA
gagccgttcttcaggttctt

SEQ ID NO: 1881 - DNA, 20 bp, synthetic construct
  source 1..20: mol_type = other DNA
gcctggagccctgaccgctc

SEQ ID NO: 1882 - DNA, 20 bp, synthetic construct
  source 1..20: mol_type = other DNA
atgcaataacctgattggtt

SEQ ID NO: 1883 - DNA, 20 bp, synthetic construct
  source 1..20: mol_type = other DNA
attcatccctttaaaccaca

SEQ ID NO: 1884 - DNA, 20 bp, synthetic construct
  source 1..20: mol_type = other DNA
tcagtcccccaaacctttcc

SEQ ID NO: 1885 - DNA, 20 bp, synthetic construct
  source 1..20: mol_type = other DNA
gatgcattcaaaacccacaa

SEQ ID NO: 1886 - DNA, 20 bp, synthetic construct
  source 1..20: mol_type = other DNA
tgactgcaagaatgagccca

SEQ ID NO: 1887 - DNA, 20 bp, synthetic construct
  source 1..20: mol_type = other DNA
caattattttataattccta

SEQ ID NO: 1888 - DNA, 20 bp, synthetic construct
  source 1..20: mol_type = other DNA
gtggacatagtacagaggca

SEQ ID NO: 1889 - DNA, 20 bp, synthetic construct
  source 1..20: mol_type = other DNA
aggctcacaattccaagtta

SEQ ID NO: 1890 - DNA, 20 bp, synthetic construct
  source 1..20: mol_type = other DNA
tggagatttttctctctatg

SEQ ID NO: 1891 - DNA, 20 bp, synthetic construct
  source 1..20: mol_type = other DNA
ctgtatatttattacttgat

SEQ ID NO: 1892 - DNA, 20 bp, synthetic construct
  source 1..20: mol_type = other DNA
tcgacattcatttttctttt

SEQ ID NO: 1893 - DNA, 20 bp, synthetic construct
  source 1..20: mol_type = other DNA
atgtcaaacatcatctctga

SEQ ID NO: 1894 - DNA, 20 bp, synthetic construct
  source 1..20: mol_type = other DNA
gggtgcttaatatccccaca

SEQ ID NO: 1895 - DNA, 20 bp, synthetic construct
  source 1..20: mol_type = other DNA
gaaggccttcagattggcca

SEQ ID NO: 1896 - DNA, 20 bp, synthetic construct
  source 1..20: mol_type = other DNA
agtctggtagtgccctcaac

SEQ ID NO: 1897 - DNA, 20 bp, synthetic construct
  source 1..20: mol_type = other DNA
acaaatagacacaccacgat

SEQ ID NO: 1898 - DNA, 20 bp, synthetic construct
  source 1..20: mol_type = other DNA
gttgagttacaaatataaat

SEQ ID NO: 1899 - DNA, 20 bp, synthetic construct
  source 1..20: mol_type = other DNA
ccaggattttaaaaaaagca

SEQ ID NO: 1900 - DNA, 20 bp, synthetic construct
  source 1..20: mol_type = other DNA
gctaaatttccttaagcttt

SEQ ID NO: 1901 - DNA, 20 bp, synthetic construct
  source 1..20: mol_type = other DNA
catcagttccaaaacctgga

SEQ ID NO: 1902 - DNA, 20 bp, synthetic construct
  source 1..20: mol_type = other DNA
ccaatacacctttatttttc

SEQ ID NO: 1903 - DNA, 20 bp, synthetic construct
  source 1..20: mol_type = other DNA
cgattaatcccttatgtttt

SEQ ID NO: 1904 - DNA, 20 bp, synthetic construct
  source 1..20: mol_type = other DNA
ctcttcaaaaacatatccga

SEQ ID NO: 1905 - DNA, 20 bp, synthetic construct
  source 1..20: mol_type = other DNA
ttctaaatttaaaactccaa

SEQ ID NO: 1906 - DNA, 20 bp, synthetic construct
  source 1..20: mol_type = other DNA
acaggcaatatttactataa

SEQ ID NO: 1907 - DNA, 20 bp, synthetic construct
  source 1..20: mol_type = other DNA
gccttcttcctttatagcac

SEQ ID NO: 1908 - DNA, 20 bp, synthetic construct
  source 1..20: mol_type = other DNA
ttaggctattaaataataga

SEQ ID NO: 1909 - DNA, 20 bp, synthetic construct
  source 1..20: mol_type = other DNA
ctcagtatcttttaattgcc

SEQ ID NO: 1910 - DNA, 20 bp, synthetic construct
  source 1..20: mol_type = other DNA
tgggccaaaaacaccccttt

SEQ ID NO: 1911 - DNA, 20 bp, synthetic construct
  source 1..20: mol_type = other DNA
ctgtttaaaaatgtattgag

SEQ ID NO: 1912 - DNA, 20 bp, synthetic construct
  source 1..20: mol_type = other DNA
gtcccttatccttaacacac

SEQ ID NO: 1913 - DNA, 20 bp, synthetic construct
  source 1..20: mol_type = other DNA
ccctaaatttaaattctctg

SEQ ID NO: 1914 - DNA, 20 bp, synthetic construct
  source 1..20: mol_type = other DNA
acctttatttaaattttcca

SEQ ID NO: 1915 - DNA, 20 bp, synthetic construct
  source 1..20: mol_type = other DNA
gctcaatatatttatctatt

SEQ ID NO: 1916 - DNA, 20 bp, synthetic construct
  source 1..20: mol_type = other DNA
tctgtattttaaaaatctct

SEQ ID NO: 1917 - DNA, 20 bp, synthetic construct
  source 1..20: mol_type = other DNA
cgagaacccttaatcctgcc

SEQ ID NO: 1918 - DNA, 20 bp, synthetic construct
  source 1..20: mol_type = other DNA
cgaaggcatataccactgta

SEQ ID NO: 1919 - DNA, 20 bp, synthetic construct
  source 1..20: mol_type = other DNA
ccactctaaccaatcctaaa

SEQ ID NO: 1920 - DNA, 20 bp, synthetic construct
  source 1..20: mol_type = other DNA
ttttattttctgatgctttg

SEQ ID NO: 1921 - DNA, 20 bp, synthetic construct
  source 1..20: mol_type = other DNA
catgactattttcaactcaa

SEQ ID NO: 1922 - DNA, 20 bp, synthetic construct
  source 1..20: mol_type = other DNA
gctgtattattatgccattt

SEQ ID NO: 1923 - DNA, 20 bp, synthetic construct
  source 1..20: mol_type = other DNA
gtcgcatttctaaacaaaac

SEQ ID NO: 1924 - DNA, 20 bp, synthetic construct
  source 1..20: mol_type = other DNA
agtgacaaatcattggttgc

SEQ ID NO: 1925 - DNA, 20 bp, synthetic construct
  source 1..20: mol_type = other DNA
agtcacaatgccatctgttt

SEQ ID NO: 1926 - DNA, 20 bp, synthetic construct
  source 1..20: mol_type = other DNA
gctaataaatttttacaagg

SEQ ID NO: 1927 - DNA, 20 bp, synthetic construct
  source 1..20: mol_type = other DNA
tgctatcaccctccactgaa

SEQ ID NO: 1928 - DNA, 20 bp, synthetic construct
  source 1..20: mol_type = other DNA
cttccataaactctttttag

SEQ ID NO: 1929 - DNA, 20 bp, synthetic construct
  source 1..20: mol_type = other DNA
cagatggaagccaaaggctc

SEQ ID NO: 1930 - DNA, 20 bp, synthetic construct
  source 1..20: mol_type = other DNA
cagctaatccattcaatgca

SEQ ID NO: 1931 - DNA, 20 bp, synthetic construct
  source 1..20: mol_type = other DNA
gctataaacaacaacagtct

SEQ ID NO: 1932 - DNA, 20 bp, synthetic construct
  source 1..20: mol_type = other DNA
cacggaagcccttaggcaca

SEQ ID NO: 1933 - DNA, 20 bp, synthetic construct
  source 1..20: mol_type = other DNA
gagagacccatttactgcaa

SEQ ID NO: 1934 - DNA, 20 bp, synthetic construct
  source 1..20: mol_type = other DNA
gttttacaaaacattttttc

SEQ ID NO: 1935 - DNA, 20 bp, synthetic construct
  source 1..20: mol_type = other DNA
aattcctttcaccacttagt

SEQ ID NO: 1936 - DNA, 20 bp, synthetic construct
  source 1..20: mol_type = other DNA
ctctgtctttcatctctgga

SEQ ID NO: 1937 - DNA, 20 bp, synthetic construct
  source 1..20: mol_type = other DNA
cccaatgaaaataaactcat

SEQ ID NO: 1938 - DNA, 20 bp, synthetic construct
  source 1..20: mol_type = other DNA
ctctttccccaaactcagtg

SEQ ID NO: 1939 - DNA, 20 bp, synthetic construct
  source 1..20: mol_type = other DNA
gttctatttaaaataacaac

SEQ ID NO: 1940 - DNA, 20 bp, synthetic construct
  source 1..20: mol_type = other DNA
tataagcaaactgtatgggt

SEQ ID NO: 1941 - DNA, 20 bp, synthetic construct
  source 1..20: mol_type = other DNA
tcaggctttccagttttaat

SEQ ID NO: 1942 - DNA, 20 bp, synthetic construct
  source 1..20: mol_type = other DNA
ctccatctcaaaacatgctg

SEQ ID NO: 1943 - DNA, 20 bp, synthetic construct
  source 1..20: mol_type = other DNA
caatgtactttttccccctt

SEQ ID NO: 1944 - DNA, 20 bp, synthetic construct
  source 1..20: mol_type = other DNA
aatgaaatttatgttaacct

SEQ ID NO: 1945 - DNA, 20 bp, synthetic construct
  source 1..20: mol_type = other DNA
ttggagattttacttaattt

SEQ ID NO: 1946 - DNA, 20 bp, synthetic construct
  source 1..20: mol_type = other DNA
accgagataatatacacaaa

SEQ ID NO: 1947 - DNA, 20 bp, synthetic construct
  source 1..20: mol_type = other DNA
taggtaaacttatctgagga

SEQ ID NO: 1948 - DNA, 20 bp, synthetic construct
  source 1..20: mol_type = other DNA
tcaggtgttaacatctgtct

SEQ ID NO: 1949 - DNA, 20 bp, synthetic construct
  source 1..20: mol_type = other DNA
ctcatacaattctagttacc

SEQ ID NO: 1950 - DNA, 20 bp, synthetic construct
  source 1..20: mol_type = other DNA
gggaaagtttcattgttctg

SEQ ID NO: 1951 - DNA, 20 bp, synthetic construct
  source 1..20: mol_type = other DNA
gcaaaaagatccttccagaa

SEQ ID NO: 1952 - DNA, 20 bp, synthetic construct
  source 1..20: mol_type = other DNA
gctaacagacacataatttg

SEQ ID NO: 1953 - DNA, 20 bp, synthetic construct
  source 1..20: mol_type = other DNA
cactagcaaaatatcagatc

SEQ ID NO: 1954 - DNA, 20 bp, synthetic construct
  source 1..20: mol_type = other DNA
aactttttttcttatagtac

SEQ ID NO: 1955 - DNA, 20 bp, synthetic construct
  source 1..20: mol_type = other DNA
ttcaaaatattccatcaagt

SEQ ID NO: 1956 - DNA, 20 bp, synthetic construct
  source 1..20: mol_type = other DNA
tcaccgttcaggacctcctt

SEQ ID NO: 1957 - DNA, 20 bp, synthetic construct
  source 1..20: mol_type = other DNA
gccctttttaacagagccgt

SEQ ID NO: 1958 - DNA, 20 bp, synthetic construct
  source 1..20: mol_type = other DNA
gccccgttcctttcttcccc

SEQ ID NO: 1959 - DNA, 20 bp, synthetic construct
  source 1..20: mol_type = other DNA
gggagtgaagtcaatgcaat

SEQ ID NO: 1960 - DNA, 20 bp, synthetic construct
  source 1..20: mol_type = other DNA
cattcatccctttaaaccac

SEQ ID NO: 1961 - DNA, 20 bp, synthetic construct
  source 1..20: mol_type = other DNA
gttcagtcccccaaaccttt

SEQ ID NO: 1962 - DNA, 20 bp, synthetic construct
  source 1..20: mol_type = other DNA
agatgcattcaaaacccaca

SEQ ID NO: 1963 - DNA, 20 bp, synthetic construct
  source 1..20: mol_type = other DNA
cagcactaaataagcagtat

SEQ ID NO: 1964 - DNA, 20 bp, synthetic construct
  source 1..20: mol_type = other DNA
accaattattttataattcc

SEQ ID NO: 1965 - DNA, 20 bp, synthetic construct
  source 1..20: mol_type = other DNA
ctgtcggtaaatattgcaaa

SEQ ID NO: 1966 - DNA, 20 bp, synthetic construct
  source 1..20: mol_type = other DNA
ctaacagaaaacatagaggc

SEQ ID NO: 1967 - DNA, 20 bp, synthetic construct
  source 1..20: mol_type = other DNA
ttggagatttttctctctat

SEQ ID NO: 1968 - DNA, 20 bp, synthetic construct
  source 1..20: mol_type = other DNA
tctgtatatttattacttga

SEQ ID NO: 1969 - DNA, 20 bp, synthetic construct
  source 1..20: mol_type = other DNA
gccatatctttcaaacactg

SEQ ID NO: 1970 - DNA, 20 bp, synthetic construct
  source 1..20: mol_type = other DNA
aatgtcaaacatcatctctg

SEQ ID NO: 1971 - DNA, 20 bp, synthetic construct
  source 1..20: mol_type = other DNA
aatttaagaattgtaagtgg

SEQ ID NO: 1972 - DNA, 20 bp, synthetic construct
  source 1..20: mol_type = other DNA
aacgaaggccttcagattgg

SEQ ID NO: 1973 - DNA, 20 bp, synthetic construct
  source 1..20: mol_type = other DNA
tagttctcctctgtactggc

SEQ ID NO: 1974 - DNA, 20 bp, synthetic construct
  source 1..20: mol_type = other DNA
ctacaaatagacacaccacg

SEQ ID NO: 1975 - DNA, 20 bp, synthetic construct
  source 1..20: mol_type = other DNA
aacagtagccaaaatgttct

SEQ ID NO: 1976 - DNA, 20 bp, synthetic construct
  source 1..20: mol_type = other DNA
ctagaattttaaaaaaccag

SEQ ID NO: 1977 - DNA, 20 bp, synthetic construct
  source 1..20: mol_type = other DNA
agtacaatcttttatagata

SEQ ID NO: 1978 - DNA, 20 bp, synthetic construct
  source 1..20: mol_type = other DNA
tgcctgagaatttaatacta

SEQ ID NO: 1979 - DNA, 20 bp, synthetic construct
  source 1..20: mol_type = other DNA
agtaagcttctttaacttta

SEQ ID NO: 1980 - DNA, 20 bp, synthetic construct
  source 1..20: mol_type = other DNA
tggataattatttaattcat

SEQ ID NO: 1981 - DNA, 20 bp, synthetic construct
  source 1..20: mol_type = other DNA
ccaaactaagaataatctag

SEQ ID NO: 1982 - DNA, 20 bp, synthetic construct
  source 1..20: mol_type = other DNA
gaggaaattatttactggct

SEQ ID NO: 1983 - DNA, 20 bp, synthetic construct
  source 1..20: mol_type = other DNA
atgcacatacaaataagctc

SEQ ID NO: 1984 - DNA, 20 bp, synthetic construct
  source 1..20: mol_type = other DNA
gagattaaaatacaattgct

SEQ ID NO: 1985 - DNA, 20 bp, synthetic construct
  source 1..20: mol_type = other DNA
gatttctccttttaacctct

SEQ ID NO: 1986 - DNA, 20 bp, synthetic construct
  source 1..20: mol_type = other DNA
ttctcaaaaccttatctcct

SEQ ID NO: 1987 - DNA, 20 bp, synthetic construct
  source 1..20: mol_type = other DNA
cattttattccttatcctac

SEQ ID NO: 1988 - DNA, 20 bp, synthetic construct
  source 1..20: mol_type = other DNA
catttgcacctttaatttgt

SEQ ID NO: 1989 - DNA, 20 bp, synthetic construct
  source 1..20: mol_type = other DNA
ttccaaaaagaatgtgtccc

SEQ ID NO: 1990 - DNA, 20 bp, synthetic construct
  source 1..20: mol_type = other DNA
ggtagctatcattattaagc

SEQ ID NO: 1991 - DNA, 20 bp, synthetic construct
  source 1..20: mol_type = other DNA
cgacagaaaatatatctgct

SEQ ID NO: 1992 - DNA, 20 bp, synthetic construct
  source 1..20: mol_type = other DNA
gactgcaaaattcccattgc

SEQ ID NO: 1993 - DNA, 20 bp, synthetic construct
  source 1..20: mol_type = other DNA
ctgtaaaaatacacatcctc

SEQ ID NO: 1994 - DNA, 20 bp, synthetic construct
  source 1..20: mol_type = other DNA
cccgagaacccttaatcctg

SEQ ID NO: 1995 - DNA, 20 bp, synthetic construct
  source 1..20: mol_type = other DNA
cacaggttcagccatagctc

SEQ ID NO: 1996 - DNA, 20 bp, synthetic construct
  source 1..20: mol_type = other DNA
tccactctaaccaatcctaa

SEQ ID NO: 1997 - DNA, 20 bp, synthetic construct
  source 1..20: mol_type = other DNA
cgcttttattttctgatgct

SEQ ID NO: 1998 - DNA, 20 bp, synthetic construct
  source 1..20: mol_type = other DNA
tcatgactattttcaactca

SEQ ID NO: 1999 - DNA, 20 bp, synthetic construct
  source 1..20: mol_type = other DNA
agctgtattattatgccatt

SEQ ID NO: 2000 - DNA, 20 bp, synthetic construct
  source 1..20: mol_type = other DNA
agtcgcatttctaaacaaaa

SEQ ID NO: 2001 - DNA, 20 bp, synthetic construct
  source 1..20: mol_type = other DNA
aagtgacaaatcattggttg

SEQ ID NO: 2002 - DNA, 20 bp, synthetic construct
  source 1..20: mol_type = other DNA
gcctagagtcacaatgccat

SEQ ID NO: 2003 - DNA, 20 bp, synthetic construct
  source 1..20: mol_type = other DNA
cgctaataaatttttacaag

SEQ ID NO: 2004 - DNA, 20 bp, synthetic construct
  source 1..20: mol_type = other DNA
tcaaccagaatcaaggcatg

SEQ ID NO: 2005 - DNA, 20 bp, synthetic construct
  source 1..20: mol_type = other DNA
ctctccttccataaactctt

SEQ ID NO: 2006 - DNA, 20 bp, synthetic construct
  source 1..20: mol_type = other DNA
gatgggataatatagaacgc

SEQ ID NO: 2007 - DNA, 20 bp, synthetic construct
  source 1..20: mol_type = other DNA
ccagctaatccattcaatgc

SEQ ID NO: 2008 - DNA, 20 bp, synthetic construct
  source 1..20: mol_type = other DNA
atgctataaacaacaacagt

SEQ ID NO: 2009 - DNA, 20 bp, synthetic construct
  source 1..20: mol_type = other DNA
gacacggaagcccttaggca

SEQ ID NO: 2010 - DNA, 20 bp, synthetic construct
  source 1..20: mol_type = other DNA
gcgagagacccatttactgc

SEQ ID NO: 2011 - DNA, 20 bp, synthetic construct
  source 1..20: mol_type = other DNA
ggcatctgttttacaaaaca

SEQ ID NO: 2012 - DNA, 20 bp, synthetic construct
  source 1..20: mol_type = other DNA
aataaaattcctttcaccac

SEQ ID NO: 2013 - DNA, 20 bp, synthetic construct
  source 1..20: mol_type = other DNA
ctttatacttttgtaagctt

SEQ ID NO: 2014 - DNA, 20 bp, synthetic construct
  source 1..20: mol_type = other DNA
tcccaatgaaaataaactca

SEQ ID NO: 2015 - DNA, 20 bp, synthetic construct
  source 1..20: mol_type = other DNA
gcctctttccccaaactcag

SEQ ID NO: 2016 - DNA, 20 bp, synthetic construct
  source 1..20: mol_type = other DNA
cagttctatttaaaataaca

SEQ ID NO: 2017 - DNA, 20 bp, synthetic construct
  source 1..20: mol_type = other DNA
atcccaattataagcaaact

SEQ ID NO: 2018 - DNA, 20 bp, synthetic construct
  source 1..20: mol_type = other DNA
tttcaggctttccagtttta

SEQ ID NO: 2019 - DNA, 20 bp, synthetic construct
  source 1..20: mol_type = other DNA
tctccatctcaaaacatgct

SEQ ID NO: 2020 - DNA, 20 bp, synthetic construct
  source 1..20: mol_type = other DNA
ctacctagacaatgtacttt

SEQ ID NO: 2021 - DNA, 20 bp, synthetic construct
  source 1..20: mol_type = other DNA
cccacctggcctgttaatga

SEQ ID NO: 2022 - DNA, 20 bp, synthetic construct
  source 1..20: mol_type = other DNA
ccagcctaaaaaattggaga

SEQ ID NO: 2023 - DNA, 20 bp, synthetic construct
  source 1..20: mol_type = other DNA
caccgagataatatacacaa

SEQ ID NO: 2024 - DNA, 20 bp, synthetic construct
  source 1..20: mol_type = other DNA
actgtgttctcataggtaaa

SEQ ID NO: 2025 - DNA, 20 bp, synthetic construct
  source 1..20: mol_type = other DNA
aagtcataaaaataaaactc

SEQ ID NO: 2026 - DNA, 20 bp, synthetic construct
  source 1..20: mol_type = other DNA
actcatacaattctagttac

SEQ ID NO: 2027 - DNA, 20 bp, synthetic construct
  source 1..20: mol_type = other DNA
agcatgaaccccttctcctg

SEQ ID NO: 2028 - DNA, 20 bp, synthetic construct
  source 1..20: mol_type = other DNA
agcaaaaagatccttccaga

SEQ ID NO: 2029 - DNA, 20 bp, synthetic construct
  source 1..20: mol_type = other DNA
atagagacaaaaagatggtc

SEQ ID NO: 2030 - DNA, 20 bp, synthetic construct
  source 1..20: mol_type = other DNA
gcactagcaaaatatcagat

SEQ ID NO: 2031 - DNA, 20 bp, synthetic construct
  source 1..20: mol_type = other DNA
tctggacaaaatgtttaaac

SEQ ID NO: 2032 - DNA, 20 bp, synthetic construct
  source 1..20: mol_type = other DNA
aatattcaaaatattccatc

SEQ ID NO: 2033 - DNA, 20 bp, synthetic construct
  source 1..20: mol_type = other DNA
ctcaccgttcaggacctcct

SEQ ID NO: 2034 - DNA, 20 bp, synthetic construct
  source 1..20: mol_type = other DNA
tggccctttttaacagagcc

SEQ ID NO: 2035 - DNA, 20 bp, synthetic construct
  source 1..20: mol_type = other DNA
agccccgttcctttcttccc

SEQ ID NO: 2036 - DNA, 20 bp, synthetic construct
  source 1..20: mol_type = other DNA
ttgcatctacctcttgggag

SEQ ID NO: 2037 - DNA, 20 bp, synthetic construct
  source 1..20: mol_type = other DNA
acattcatccctttaaacca

SEQ ID NO: 2038 - DNA, 20 bp, synthetic construct
  source 1..20: mol_type = other DNA
gctacatttatttatgctcg

SEQ ID NO: 2039 - DNA, 20 bp, synthetic construct
  source 1..20: mol_type = other DNA
gcactttaaagatgcattca

SEQ ID NO: 2040 - DNA, 20 bp, synthetic construct
  source 1..20: mol_type = other DNA
acagcactaaataagcagta

SEQ ID NO: 2041 - DNA, 20 bp, synthetic construct
  source 1..20: mol_type = other DNA
aaccaattattttataattc

SEQ ID NO: 2042 - DNA, 20 bp, synthetic construct
  source 1..20: mol_type = other DNA
gctgtcggtaaatattgcaa

SEQ ID NO: 2043 - DNA, 20 bp, synthetic construct
  source 1..20: mol_type = other DNA
acctaacagaaaacatagag

SEQ ID NO: 2044 - DNA, 20 bp, synthetic construct
  source 1..20: mol_type = other DNA
agtgtcttcaaaagcattgg

SEQ ID NO: 2045 - DNA, 20 bp, synthetic construct
  source 1..20: mol_type = other DNA
tctctgtatatttattactt

SEQ ID NO: 2046 - DNA, 20 bp, synthetic construct
  source 1..20: mol_type = other DNA
agccatatctttcaaacact

SEQ ID NO: 2047 - DNA, 20 bp, synthetic construct
  source 1..20: mol_type = other DNA
tctttgggtttataggaaca

SEQ ID NO: 2048 - DNA, 20 bp, synthetic construct
  source 1..20: mol_type = other DNA
ttctgaatttaagaattgta

SEQ ID NO: 2049 - DNA, 20 bp, synthetic construct
  source 1..20: mol_type = other DNA
cacttccaacgaaggccttc

SEQ ID NO: 2050 - DNA, 20 bp, synthetic construct
  source 1..20: mol_type = other DNA
ccctagttctcctctgtact

SEQ ID NO: 2051 - DNA, 20 bp, synthetic construct
  source 1..20: mol_type = other DNA
gtatcctacaaatagacaca

SEQ ID NO: 2052 - DNA, 20 bp, synthetic construct
  source 1..20: mol_type = other DNA
actcactatttttaagagca

SEQ ID NO: 2053 - DNA, 20 bp, synthetic construct
  source 1..20: mol_type = other DNA
ctgggaatttaaaaaacaaa

SEQ ID NO: 2054 - DNA, 20 bp, synthetic construct
  source 1..20: mol_type = other DNA
tccataaacatttatacaga

SEQ ID NO: 2055 - DNA, 20 bp, synthetic construct
  source 1..20: mol_type = other DNA
ggttcaaaaccttagtcaga

SEQ ID NO: 2056 - DNA, 20 bp, synthetic construct
  source 1..20: mol_type = other DNA
atagaatatttttatcattc

SEQ ID NO: 2057 - DNA, 20 bp, synthetic construct
  source 1..20: mol_type = other DNA
gaataaattatttactgcgg

SEQ ID NO: 2058 - DNA, 20 bp, synthetic construct
  source 1..20: mol_type = other DNA
ggtcaatttcaaactgttct

SEQ ID NO: 2059 - DNA, 20 bp, synthetic construct
  source 1..20: mol_type = other DNA
ggcctaaaactattcttgat

SEQ ID NO: 2060 - DNA, 20 bp, synthetic construct
  source 1..20: mol_type = other DNA
acacttaaacctgttaatat

SEQ ID NO: 2061 - DNA, 20 bp, synthetic construct
  source 1..20: mol_type = other DNA
gctcataaaatacctctcta

SEQ ID NO: 2062 - DNA, 20 bp, synthetic construct
  source 1..20: mol_type = other DNA
ccaggaaagatttatttagc

SEQ ID NO: 2063 - DNA, 20 bp, synthetic construct
  source 1..20: mol_type = other DNA
agcacatttcaaaagttcag

SEQ ID NO: 2064 - DNA, 20 bp, synthetic construct
  source 1..20: mol_type = other DNA
attcattttccttatgttac

SEQ ID NO: 2065 - DNA, 20 bp, synthetic construct
  source 1..20: mol_type = other DNA
tcacccaaacccattgccta

SEQ ID NO: 2066 - DNA, 20 bp, synthetic construct
  source 1..20: mol_type = other DNA
ttctgtaaaatatatcctgt

SEQ ID NO: 2067 - DNA, 20 bp, synthetic construct
  source 1..20: mol_type = other DNA
atctgtaaaatatggttgca

SEQ ID NO: 2068 - DNA, 20 bp, synthetic construct
  source 1..20: mol_type = other DNA
aacttattttaaagtgtcca

SEQ ID NO: 2069 - DNA, 20 bp, synthetic construct
  source 1..20: mol_type = other DNA
acattatacccttaatatcc

SEQ ID NO: 2070 - DNA, 20 bp, synthetic construct
  source 1..20: mol_type = other DNA
gctgtaaaaatacacatcct

SEQ ID NO: 2071 - DNA, 20 bp, synthetic construct
  source 1..20: mol_type = other DNA
gcttattttttctagagaac

SEQ ID NO: 2072 - DNA, 20 bp, synthetic construct
  source 1..20: mol_type = other DNA
agtgatagtcacaggttcag

SEQ ID NO: 2073 - DNA, 20 bp, synthetic construct
  source 1..20: mol_type = other DNA
ttatccactctaaccaatcc

SEQ ID NO: 2074 - DNA, 20 bp, synthetic construct
  source 1..20: mol_type = other DNA
ccacgcttttattttctgat

SEQ ID NO: 2075 - DNA, 20 bp, synthetic construct
  source 1..20: mol_type = other DNA
cagctatttcatgactattt

SEQ ID NO: 2076 - DNA, 20 bp, synthetic construct
  source 1..20: mol_type = other DNA
gagctgtattattatgccat

SEQ ID NO: 2077 - DNA, 20 bp, synthetic construct
  source 1..20: mol_type = other DNA
cagtcgcatttctaaacaaa

SEQ ID NO: 2078 - DNA, 20 bp, synthetic construct
  source 1..20: mol_type = other DNA
cggtaaagtgacaaatcatt

SEQ ID NO: 2079 - DNA, 20 bp, synthetic construct
  source 1..20: mol_type = other DNA
ctgcctagagtcacaatgcc

SEQ ID NO: 2080 - DNA, 20 bp, synthetic construct
  source 1..20: mol_type = other DNA
acgctaataaatttttacaa

SEQ ID NO: 2081 - DNA, 20 bp, synthetic construct
  source 1..20: mol_type = other DNA
actctcaaccagaatcaagg

SEQ ID NO: 2082 - DNA, 20 bp, synthetic construct
  source 1..20: mol_type = other DNA
cctctccttccataaactct

SEQ ID NO: 2083 - DNA, 20 bp, synthetic construct
  source 1..20: mol_type = other DNA
ctgtgtactcttcagagaag

SEQ ID NO: 2084 - DNA, 20 bp, synthetic construct
  source 1..20: mol_type = other DNA
accagctaatccattcaatg

SEQ ID NO: 2085 - DNA, 20 bp, synthetic construct
  source 1..20: mol_type = other DNA
aacaatagtctttaattttt

SEQ ID NO: 2086 - DNA, 20 bp, synthetic construct
  source 1..20: mol_type = other DNA
gtgagtgaccacagcagctg

SEQ ID NO: 2087 - DNA, 20 bp, synthetic construct
  source 1..20: mol_type = other DNA
agcgagagacccatttactg

SEQ ID NO: 2088 - DNA, 20 bp, synthetic construct
  source 1..20: mol_type = other DNA
ctgttttcacaaattgcgaa

SEQ ID NO: 2089 - DNA, 20 bp, synthetic construct
  source 1..20: mol_type = other DNA
caataaaattcctttcacca

SEQ ID NO: 2090 - DNA, 20 bp, synthetic construct
  source 1..20: mol_type = other DNA
gcctttatacttttgtaagc

SEQ ID NO: 2091 - DNA, 20 bp, synthetic construct
  source 1..20: mol_type = other DNA
gtttctgattaaatcccaat

SEQ ID NO: 2092 - DNA, 20 bp, synthetic construct
  source 1..20: mol_type = other DNA
tgcctctttccccaaactca

SEQ ID NO: 2093 - DNA, 20 bp, synthetic construct
  source 1..20: mol_type = other DNA
gagaactcccctgacagttc

SEQ ID NO: 2094 - DNA, 20 bp, synthetic construct
  source 1..20: mol_type = other DNA
acatcacaaacatcccaatt

SEQ ID NO: 2095 - DNA, 20 bp, synthetic construct
  source 1..20: mol_type = other DNA
gatacatttcaggctttcca

SEQ ID NO: 2096 - DNA, 20 bp, synthetic construct
  source 1..20: mol_type = other DNA
cttgaaattcccttggagag

SEQ ID NO: 2097 - DNA, 20 bp, synthetic construct
  source 1..20: mol_type = other DNA
aactacctagacaatgtact

SEQ ID NO: 2098 - DNA, 20 bp, synthetic construct
  source 1..20: mol_type = other DNA
cgtactaaaacaagatgacg

SEQ ID NO: 2099 - DNA, 20 bp, synthetic construct
  source 1..20: mol_type = other DNA
accagcctaaaaaattggag

SEQ ID NO: 2100 - DNA, 20 bp, synthetic construct
  source 1..20: mol_type = other DNA
gcaccgagataatatacaca

SEQ ID NO: 2101 - DNA, 20 bp, synthetic construct
  source 1..20: mol_type = other DNA
tctgaaaataacatctactg

SEQ ID NO: 2102 - DNA, 20 bp, synthetic construct
  source 1..20: mol_type = other DNA
ccaagtcataaaaataaaac

SEQ ID NO: 2103 - DNA, 20 bp, synthetic construct
  source 1..20: mol_type = other DNA
atagccactcatacaattct

SEQ ID NO: 2104 - DNA, 20 bp, synthetic construct
  source 1..20: mol_type = other DNA
aagcatgaaccccttctcct

SEQ ID NO: 2105 - DNA, 20 bp, synthetic construct
  source 1..20: mol_type = other DNA
ggagcaaaaagatccttcca

SEQ ID NO: 2106 - DNA, 20 bp, synthetic construct
  source 1..20: mol_type = other DNA
ggattctctaattagagctt

SEQ ID NO: 2107 - DNA, 20 bp, synthetic construct
  source 1..20: mol_type = other DNA
gaggagaccagatagcttgt

SEQ ID NO: 2108 - DNA, 20 bp, synthetic construct
  source 1..20: mol_type = other DNA
ctctggacaaaatgtttaaa

SEQ ID NO: 2109 - DNA, 20 bp, synthetic construct
  source 1..20: mol_type = other DNA
tcaatattcaaaatattcca

SEQ ID NO: 2110 - DNA, 20 bp, synthetic construct
  source 1..20: mol_type = other DNA
gggcaggaccatcacagagg

SEQ ID NO: 2111 - DNA, 20 bp, synthetic construct
  source 1..20: mol_type = other DNA
ctggccctttttaacagagc

SEQ ID NO: 2112 - DNA, 20 bp, synthetic construct
  source 1..20: mol_type = other DNA
ctgcaggacccttcccacgg

SEQ ID NO: 2113 - DNA, 20 bp, synthetic construct
  source 1..20: mol_type = other DNA
tcaaagacaaaaagatttcg

SEQ ID NO: 2114 - DNA, 20 bp, synthetic construct
  source 1..20: mol_type = other DNA
attcacattcatccctttaa

SEQ ID NO: 2115 - DNA, 20 bp, synthetic construct
  source 1..20: mol_type = other DNA
gttagaaagaaattttgcta

SEQ ID NO: 2116 - DNA, 20 bp, synthetic construct
  source 1..20: mol_type = other DNA
cctacttataaaactttttt

SEQ ID NO: 2117 - DNA, 20 bp, synthetic construct
  source 1..20: mol_type = other DNA
tacagcactaaataagcagt

SEQ ID NO: 2118 - DNA, 20 bp, synthetic construct
  source 1..20: mol_type = other DNA
cacatgctaaaaaagcaaga

SEQ ID NO: 2119 - DNA, 20 bp, synthetic construct
  source 1..20: mol_type = other DNA
aagaaagaacaaaagacggc

SEQ ID NO: 2120 - DNA, 20 bp, synthetic construct
  source 1..20: mol_type = other DNA
cacctaacagaaaacataga

SEQ ID NO: 2121 - DNA, 20 bp, synthetic construct
  source 1..20: mol_type = other DNA
tagtgtcttcaaaagcattg

SEQ ID NO: 2122 - DNA, 20 bp, synthetic construct
  source 1..20: mol_type = other DNA
agtatattctctgtatattt

SEQ ID NO: 2123 - DNA, 20 bp, synthetic construct
  source 1..20: mol_type = other DNA
gagccatatctttcaaacac

SEQ ID NO: 2124 - DNA, 20 bp, synthetic construct
  source 1..20: mol_type = other DNA
ttcaagattatattctttgg

SEQ ID NO: 2125 - DNA, 20 bp, synthetic construct
  source 1..20: mol_type = other DNA
gttgccttcaacgagaaggg

SEQ ID NO: 2126 - DNA, 20 bp, synthetic construct
  source 1..20: mol_type = other DNA
actgtaaacaacacttccaa

SEQ ID NO: 2127 - DNA, 20 bp, synthetic construct
  source 1..20: mol_type = other DNA
acatcattccttccctagtt

SEQ ID NO: 2128 - DNA, 20 bp, synthetic construct
  source 1..20: mol_type = other DNA
tgtatcctacaaatagacac

SEQ ID NO: 2129 - DNA, 20 bp, synthetic construct
  source 1..20: mol_type = other DNA
ggctgattttaaacttagtt

SEQ ID NO: 2130 - DNA, 20 bp, synthetic construct
  source 1..20: mol_type = other DNA
gttttatatttttaagtgct

SEQ ID NO: 2131 - DNA, 20 bp, synthetic construct
  source 1..20: mol_type = other DNA
acatttaaaatatttcagac

SEQ ID NO: 2132 - DNA, 20 bp, synthetic construct
  source 1..20: mol_type = other DNA
tgtctattttaaagactcaa

SEQ ID NO: 2133 - DNA, 20 bp, synthetic construct
  source 1..20: mol_type = other DNA
ggatatctattttaattctt

SEQ ID NO: 2134 - DNA, 20 bp, synthetic construct
  source 1..20: mol_type = other DNA
acagtatttcaaaagaagcc

SEQ ID NO: 2135 - DNA, 20 bp, synthetic construct
  source 1..20: mol_type = other DNA
ctggataatacctaactgtc

SEQ ID NO: 2136 - DNA, 20 bp, synthetic construct
  source 1..20: mol_type = other DNA
agtgacttagattatccttt

SEQ ID NO: 2137 - DNA, 20 bp, synthetic construct
  source 1..20: mol_type = other DNA
cacatcaaacctcaagggca

SEQ ID NO: 2138 - DNA, 20 bp, synthetic construct
  source 1..20: mol_type = other DNA
gtttccctaatttatggagt

SEQ ID NO: 2139 - DNA, 20 bp, synthetic construct
  source 1..20: mol_type = other DNA
attcttacaatttacttgta

SEQ ID NO: 2140 - DNA, 20 bp, synthetic construct
  source 1..20: mol_type = other DNA
attctcttttaaagataaag

SEQ ID NO: 2141 - DNA, 20 bp, synthetic construct
  source 1..20: mol_type = other DNA
ctatggttttaaaattcatt

SEQ ID NO: 2142 - DNA, 20 bp, synthetic construct
  source 1..20: mol_type = other DNA
actaccagcccttatttcag

SEQ ID NO: 2143 - DNA, 20 bp, synthetic construct
  source 1..20: mol_type = other DNA
ctctgctttcaaatgtgttt

SEQ ID NO: 2144 - DNA, 20 bp, synthetic construct
  source 1..20: mol_type = other DNA
tctttcatattttaaagtgc

SEQ ID NO: 2145 - DNA, 20 bp, synthetic construct
  source 1..20: mol_type = other DNA
tccagtaaaaacacaacact

SEQ ID NO: 2146 - DNA, 20 bp, synthetic construct
  source 1..20: mol_type = other DNA
tataatatacattataccct

SEQ ID NO: 2147 - DNA, 20 bp, synthetic construct
  source 1..20: mol_type = other DNA
ccacaattacaaacacactt

SEQ ID NO: 2148 - DNA, 20 bp, synthetic construct
  source 1..20: mol_type = other DNA
ggcttattttttctagagaa

SEQ ID NO: 2149 - DNA, 20 bp, synthetic construct
  source 1..20: mol_type = other DNA
gcagtgatagtcacaggttc

SEQ ID NO: 2150 - DNA, 20 bp, synthetic construct
  source 1..20: mol_type = other DNA
ggaattatccactctaacca

SEQ ID NO: 2151 - DNA, 20 bp, synthetic construct
  source 1..20: mol_type = other DNA
tgtattaaccacgcttttat

SEQ ID NO: 2152 - DNA, 20 bp, synthetic construct
  source 1..20: mol_type = other DNA
agcagctatttcatgactat

SEQ ID NO: 2153 - DNA, 20 bp, synthetic construct
  source 1..20: mol_type = other DNA
gtgagctgtattattatgcc

SEQ ID NO: 2154 - DNA, 20 bp, synthetic construct
  source 1..20: mol_type = other DNA
gcaaggaaccagtcgcattt

SEQ ID NO: 2155 - DNA, 20 bp, synthetic construct
  source 1..20: mol_type = other DNA
agccgatttctgataggctc

SEQ ID NO: 2156 - DNA, 20 bp, synthetic construct
  source 1..20: mol_type = other DNA
gcaggatttctgcctagagt

SEQ ID NO: 2157 - DNA, 20 bp, synthetic construct
  source 1..20: mol_type = other DNA
atgttcatcttaatgctctt

SEQ ID NO: 2158 - DNA, 20 bp, synthetic construct
  source 1..20: mol_type = other DNA
gactctcaaccagaatcaag

SEQ ID NO: 2159 - DNA, 20 bp, synthetic construct
  source 1..20: mol_type = other DNA
tgcctctccttccataaact

SEQ ID NO: 2160 - DNA, 20 bp, synthetic construct
  source 1..20: mol_type = other DNA
ttttacaactccactgagca

SEQ ID NO: 2161 - DNA, 20 bp, synthetic construct
  source 1..20: mol_type = other DNA
ctcggctatttttaggtacc

SEQ ID NO: 2162 - DNA, 20 bp, synthetic construct
  source 1..20: mol_type = other DNA
tgctttaaacaatagtcttt

SEQ ID NO: 2163 - DNA, 20 bp, synthetic construct
  source 1..20: mol_type = other DNA
ccagtgagtgaccacagcag

SEQ ID NO: 2164 - DNA, 20 bp, synthetic construct
  source 1..20: mol_type = other DNA
accccgtctcaaagatgaag

SEQ ID NO: 2165 - DNA, 20 bp, synthetic construct
  source 1..20: mol_type = other DNA
ccctgttttcacaaattgcg

SEQ ID NO: 2166 - DNA, 20 bp, synthetic construct
  source 1..20: mol_type = other DNA
tcaataaaattcctttcacc

SEQ ID NO: 2167 - DNA, 20 bp, synthetic construct
  source 1..20: mol_type = other DNA
ggcctttatacttttgtaag

SEQ ID NO: 2168 - DNA, 20 bp, synthetic construct
  source 1..20: mol_type = other DNA
tggtttctgattaaatccca

SEQ ID NO: 2169 - DNA, 20 bp, synthetic construct
  source 1..20: mol_type = other DNA
tttacttgtatatttgtctg

SEQ ID NO: 2170 - DNA, 20 bp, synthetic construct
  source 1..20: mol_type = other DNA
ctgtccttttcagagagaac

SEQ ID NO: 2171 - DNA, 20 bp, synthetic construct
  source 1..20: mol_type = other DNA
tacatcacaaacatcccaat

SEQ ID NO: 2172 - DNA, 20 bp, synthetic construct
  source 1..20: mol_type = other DNA
aatgatacatttcaggcttt

SEQ ID NO: 2173 - DNA, 20 bp, synthetic construct
  source 1..20: mol_type = other DNA
atatatcatcaaatctgttg

SEQ ID NO: 2174 - DNA, 20 bp, synthetic construct
  source 1..20: mol_type = other DNA
ttagtgtgaactacctagac

SEQ ID NO: 2175 - DNA, 20 bp, synthetic construct
  source 1..20: mol_type = other DNA
ctgccgaaaaattcacgaga

SEQ ID NO: 2176 - DNA, 20 bp, synthetic construct
  source 1..20: mol_type = other DNA
aaccagcctaaaaaattgga

SEQ ID NO: 2177 - DNA, 20 bp, synthetic construct
  source 1..20: mol_type = other DNA
aggataattttatggcaccg

SEQ ID NO: 2178 - DNA, 20 bp, synthetic construct
  source 1..20: mol_type = other DNA
gcaatatttaattttctgaa

SEQ ID NO: 2179 - DNA, 20 bp, synthetic construct
  source 1..20: mol_type = other DNA
tgctgcaaatccaagtcata

SEQ ID NO: 2180 - DNA, 20 bp, synthetic construct
  source 1..20: mol_type = other DNA
ccttatagccactcatacaa

SEQ ID NO: 2181 - DNA, 20 bp, synthetic construct
  source 1..20: mol_type = other DNA
agtacattcatatggcagct

SEQ ID NO: 2182 - DNA, 20 bp, synthetic construct
  source 1..20: mol_type = other DNA
ggcgaattctatatggagca

SEQ ID NO: 2183 - DNA, 20 bp, synthetic construct
  source 1..20: mol_type = other DNA
aactggattctctaattaga

SEQ ID NO: 2184 - DNA, 20 bp, synthetic construct
  source 1..20: mol_type = other DNA
gcattcaatttaaaaaaggg

SEQ ID NO: 2185 - DNA, 20 bp, synthetic construct
  source 1..20: mol_type = other DNA
aataaatttaaaaactctgg

SEQ ID NO: 2186 - DNA, 20 bp, synthetic construct
  source 1..20: mol_type = other DNA
atcaatattcaaaatattcc

SEQ ID NO: 2187 - DNA, 20 bp, synthetic construct
  source 1..20: mol_type = other DNA
ctgttgcacctccaggtcag

SEQ ID NO: 2188 - DNA, 20 bp, synthetic construct
  source 1..20: mol_type = other DNA
gctggccctttttaacagag

SEQ ID NO: 2189 - DNA, 20 bp, synthetic construct
  source 1..20: mol_type = other DNA
cctgtgcacccccacatgcg

SEQ ID NO: 2190 - DNA, 20 bp, synthetic construct
  source 1..20: mol_type = other DNA
tgaactataaacagtactag

SEQ ID NO: 2191 - DNA, 20 bp, synthetic construct
  source 1..20: mol_type = other DNA
aattcacattcatcccttta

SEQ ID NO: 2192 - DNA, 20 bp, synthetic construct
  source 1..20: mol_type = other DNA
aaccttataaaatggcctag

SEQ ID NO: 2193 - DNA, 20 bp, synthetic construct
  source 1..20: mol_type = other DNA
tctccctacttataaaactt

SEQ ID NO: 2194 - DNA, 20 bp, synthetic construct
  source 1..20: mol_type = other DNA
atacagcactaaataagcag

SEQ ID NO: 2195 - DNA, 20 bp, synthetic construct
  source 1..20: mol_type = other DNA
ggtcagactctattggcaca

SEQ ID NO: 2196 - DNA, 20 bp, synthetic construct
  source 1..20: mol_type = other DNA
ttactagtttaaaaatggaa

SEQ ID NO: 2197 - DNA, 20 bp, synthetic construct
  source 1..20: mol_type = other DNA
acacactcacctaacagaaa

SEQ ID NO: 2198 - DNA, 20 bp, synthetic construct
  source 1..20: mol_type = other DNA
cttcctcacccatatctgaa

SEQ ID NO: 2199 - DNA, 20 bp, synthetic construct
  source 1..20: mol_type = other DNA
gctttataaaaaagtatatt

SEQ ID NO: 2200 - DNA, 20 bp, synthetic construct
  source 1..20: mol_type = other DNA
agagccatatctttcaaaca

SEQ ID NO: 2201 - DNA, 20 bp, synthetic construct
  source 1..20: mol_type = other DNA
tgttcaagattatattcttt

SEQ ID NO: 2202 - DNA, 20 bp, synthetic construct
  source 1..20: mol_type = other DNA
aacagttgccttcaacgaga

SEQ ID NO: 2203 - DNA, 20 bp, synthetic construct
  source 1..20: mol_type = other DNA
attactgtaaacaacacttc

SEQ ID NO: 2204 - DNA, 20 bp, synthetic construct
  source 1..20: mol_type = other DNA
aacatcattccttccctagt

SEQ ID NO: 2205 - DNA, 20 bp, synthetic construct
  source 1..20: mol_type = other DNA
gagtgtatcctacaaataga

SEQ ID NO: 2206 - DNA, 20 bp, synthetic construct
  source 1..20: mol_type = other DNA
tctagcaaacctctttttcc

SEQ ID NO: 2207 - DNA, 20 bp, synthetic construct
  source 1..20: mol_type = other DNA
aggtataaatcccctttcca

SEQ ID NO: 2208 - DNA, 20 bp, synthetic construct
  source 1..20: mol_type = other DNA
gatagtaatcaaacctgagt

SEQ ID NO: 2209 - DNA, 20 bp, synthetic construct
  source 1..20: mol_type = other DNA
atttgtctattttaaagact

SEQ ID NO: 2210 - DNA, 20 bp, synthetic construct
  source 1..20: mol_type = other DNA
atgagtaaaatatggtcctt

SEQ ID NO: 2211 - DNA, 20 bp, synthetic construct
  source 1..20: mol_type = other DNA
cacttcataatttaatattt

SEQ ID NO: 2212 - DNA, 20 bp, synthetic construct
  source 1..20: mol_type = other DNA
gtgatattttaaagacttac

SEQ ID NO: 2213 - DNA, 20 bp, synthetic construct
  source 1..20: mol_type = other DNA
agggccttattttaatcaca

SEQ ID NO: 2214 - DNA, 20 bp, synthetic construct
  source 1..20: mol_type = other DNA
catttatttccttacccagt

SEQ ID NO: 2215 - DNA, 20 bp, synthetic construct
  source 1..20: mol_type = other DNA
gtgtctaaaaccaactgggt

SEQ ID NO: 2216 - DNA, 20 bp, synthetic construct
  source 1..20: mol_type = other DNA
aagccaatattttattttga

SEQ ID NO: 2217 - DNA, 20 bp, synthetic construct
  source 1..20: mol_type = other DNA
ggtgataaagatatcattac

SEQ ID NO: 2218 - DNA, 20 bp, synthetic construct
  source 1..20: mol_type = other DNA
ttcgaaattctttatttgat

SEQ ID NO: 2219 - DNA, 20 bp, synthetic construct
  source 1..20: mol_type = other DNA
cactataaagaatgatgagt

SEQ ID NO: 2220 - DNA, 20 bp, synthetic construct
  source 1..20: mol_type = other DNA
tagagaaaacgatgttggct

SEQ ID NO: 2221 - DNA, 20 bp, synthetic construct
  source 1..20: mol_type = other DNA
ccttcggctatttaataata

SEQ ID NO: 2222 - DNA, 20 bp, synthetic construct
  source 1..20: mol_type = other DNA
aggcatctaatttaaattca

SEQ ID NO: 2223 - DNA, 20 bp, synthetic construct
  source 1..20: mol_type = other DNA
gcttgtaaaactatggcggc

SEQ ID NO: 2224 - DNA, 20 bp, synthetic construct
  source 1..20: mol_type = other DNA
ggcaataaaatatttaatgg

SEQ ID NO: 2225 - DNA, 20 bp, synthetic construct
  source 1..20: mol_type = other DNA
gggcttattttttctagaga

SEQ ID NO: 2226 - DNA, 20 bp, synthetic construct
  source 1..20: mol_type = other DNA
acattatatatatgttggag

SEQ ID NO: 2227 - DNA, 20 bp, synthetic construct
  source 1..20: mol_type = other DNA
actggaattatccactctaa

SEQ ID NO: 2228 - DNA, 20 bp, synthetic construct
  source 1..20: mol_type = other DNA
attgtattaaccacgctttt

SEQ ID NO: 2229 - DNA, 20 bp, synthetic construct
  source 1..20: mol_type = other DNA
tagcagctatttcatgacta

SEQ ID NO: 2230 - DNA, 20 bp, synthetic construct
  source 1..20: mol_type = other DNA
gtgaacagccactacagagg

SEQ ID NO: 2231 - DNA, 20 bp, synthetic construct
  source 1..20: mol_type = other DNA
ccttcattctcaagctgaag

SEQ ID NO: 2232 - DNA, 20 bp, synthetic construct
  source 1..20: mol_type = other DNA
gatgtcagccgatttctgat

SEQ ID NO: 2233 - DNA, 20 bp, synthetic construct
  source 1..20: mol_type = other DNA
aggcatcctcaagagtctgt

SEQ ID NO: 2234 - DNA, 20 bp, synthetic construct
  source 1..20: mol_type = other DNA
gtacatgttcatcttaatgc

SEQ ID NO: 2235 - DNA, 20 bp, synthetic construct
  source 1..20: mol_type = other DNA
ggactctcaaccagaatcaa

SEQ ID NO: 2236 - DNA, 20 bp, synthetic construct
  source 1..20: mol_type = other DNA
gctgcctctccttccataaa

SEQ ID NO: 2237 - DNA, 20 bp, synthetic construct
  source 1..20: mol_type = other DNA
caatacattttacaactcca

SEQ ID NO: 2238 - DNA, 20 bp, synthetic construct
  source 1..20: mol_type = other DNA
ctgactctacaggctcatgt

SEQ ID NO: 2239 - DNA, 20 bp, synthetic construct
  source 1..20: mol_type = other DNA
ctgctttaaacaatagtctt

SEQ ID NO: 2240 - DNA, 20 bp, synthetic construct
  source 1..20: mol_type = other DNA
agggatggccaggaaggaca

SEQ ID NO: 2241 - DNA, 20 bp, synthetic construct
  source 1..20: mol_type = other DNA
atcagaaaaccccgtctcaa

SEQ ID NO: 2242 - DNA, 20 bp, synthetic construct
  source 1..20: mol_type = other DNA
tccctgttttcacaaattgc

SEQ ID NO: 2243 - DNA, 20 bp, synthetic construct
  source 1..20: mol_type = other DNA
ttcaataaaattcctttcac

SEQ ID NO: 2244 - DNA, 20 bp, synthetic construct
  source 1..20: mol_type = other DNA
atggcctttatacttttgta

SEQ ID NO: 2245 - DNA, 20 bp, synthetic construct
  source 1..20: mol_type = other DNA
acacattttccagaatggtt

SEQ ID NO: 2246 - DNA, 20 bp, synthetic construct
  source 1..20: mol_type = other DNA
cttttttatttacttgtata

SEQ ID NO: 2247 - DNA, 20 bp, synthetic construct
  source 1..20: mol_type = other DNA
cactgtccttttcagagaga

SEQ ID NO: 2248 - DNA, 20 bp, synthetic construct
  source 1..20: mol_type = other DNA
cttacatcacaaacatccca

SEQ ID NO: 2249 - DNA, 20 bp, synthetic construct
  source 1..20: mol_type = other DNA
ctaatgatacatttcaggct

SEQ ID NO: 2250 - DNA, 20 bp, synthetic construct
  source 1..20: mol_type = other DNA
atatatatcatcaaatctgt

SEQ ID NO: 2251 - DNA, 20 bp, synthetic construct
  source 1..20: mol_type = other DNA
ctcctcactaattagtgtga

SEQ ID NO: 2252 - DNA, 20 bp, synthetic construct
  source 1..20: mol_type = other DNA
gcctgccgaaaaattcacga

SEQ ID NO: 2253 - DNA, 20 bp, synthetic construct
  source 1..20: mol_type = other DNA
ccaaccagcctaaaaaattg

SEQ ID NO: 2254 - DNA, 20 bp, synthetic construct
  source 1..20: mol_type = other DNA
taggataattttatggcacc

SEQ ID NO: 2255 - DNA, 20 bp, synthetic construct
  source 1..20: mol_type = other DNA
caggcaatatttaattttct

SEQ ID NO: 2256 - DNA, 20 bp, synthetic construct
  source 1..20: mol_type = other DNA
ttgctgcaaatccaagtcat

SEQ ID NO: 2257 - DNA, 20 bp, synthetic construct
  source 1..20: mol_type = other DNA
tgccttatagccactcatac

SEQ ID NO: 2258 - DNA, 20 bp, synthetic construct
  source 1..20: mol_type = other DNA
tgagtacattcatatggcag

SEQ ID NO: 2259 - DNA, 20 bp, synthetic construct
  source 1..20: mol_type = other DNA
tggcgaattctatatggagc

SEQ ID NO: 2260 - DNA, 20 bp, synthetic construct
  source 1..20: mol_type = other DNA
agttgaatagacatggatta

SEQ ID NO: 2261 - DNA, 20 bp, synthetic construct
  source 1..20: mol_type = other DNA
actttcacaattttgcaaat

SEQ ID NO: 2262 - DNA, 20 bp, synthetic construct
  source 1..20: mol_type = other DNA
tctgaacaaaaatataagca

SEQ ID NO: 2263 - DNA, 20 bp, synthetic construct
  source 1..20: mol_type = other DNA
aaggtcatcaatattcaaaa

SEQ ID NO: 2264 - DNA, 20 bp, synthetic construct
  source 1..20: mol_type = other DNA
aggcttccctaaatgcaggc

SEQ ID NO: 2265 - DNA, 20 bp, synthetic construct
  source 1..20: mol_type = other DNA
ggccgtcggcctttgagtgc

SEQ ID NO: 2266 - DNA, 20 bp, synthetic construct
  source 1..20: mol_type = other DNA
aggcagagaaaaagagaccc

SEQ ID NO: 2267 - DNA, 20 bp, synthetic construct
  source 1..20: mol_type = other DNA
agtcatgaactataaacagt

SEQ ID NO: 2268 - DNA, 20 bp, synthetic construct
  source 1..20: mol_type = other DNA
ataattcacattcatccctt

SEQ ID NO: 2269 - DNA, 20 bp, synthetic construct
  source 1..20: mol_type = other DNA
aacataaccttataaaatgg

SEQ ID NO: 2270 - DNA, 20 bp, synthetic construct
  source 1..20: mol_type = other DNA
ttctccctacttataaaact

SEQ ID NO: 2271 - DNA, 20 bp, synthetic construct
  source 1..20: mol_type = other DNA
cgtttaaaaaatacagcact

SEQ ID NO: 2272 - DNA, 20 bp, synthetic construct
  source 1..20: mol_type = other DNA
gctttaactatatagcacac

SEQ ID NO: 2273 - DNA, 20 bp, synthetic construct
  source 1..20: mol_type = other DNA
gcctgctgttactagtttaa

SEQ ID NO: 2274 - DNA, 20 bp, synthetic construct
  source 1..20: mol_type = other DNA
aacacactcacctaacagaa

SEQ ID NO: 2275 - DNA, 20 bp, synthetic construct
  source 1..20: mol_type = other DNA
ctctgcttcctcacccatat

SEQ ID NO: 2276 - DNA, 20 bp, synthetic construct
  source 1..20: mol_type = other DNA
tgctttataaaaaagtatat

SEQ ID NO: 2277 - DNA, 20 bp, synthetic construct
  source 1..20: mol_type = other DNA
ttcaacagagccatatcttt

SEQ ID NO: 2278 - DNA, 20 bp, synthetic construct
  source 1..20: mol_type = other DNA
gtgttcaagattatattctt

SEQ ID NO: 2279 - DNA, 20 bp, synthetic construct
  source 1..20: mol_type = other DNA
gttagctaccagaacagttg

SEQ ID NO: 2280 - DNA, 20 bp, synthetic construct
  source 1..20: mol_type = other DNA
gtaaggattactgtaaacaa

SEQ ID NO: 2281 - DNA, 20 bp, synthetic construct
  source 1..20: mol_type = other DNA
caaaacatcattccttccct

SEQ ID NO: 2282 - DNA, 20 bp, synthetic construct
  source 1..20: mol_type = other DNA
cgagtgtatcctacaaatag

SEQ ID NO: 2283 - DNA, 20 bp, synthetic construct
  source 1..20: mol_type = other DNA
tgccagagaatttatatgta

SEQ ID NO: 2284 - DNA, 20 bp, synthetic construct
  source 1..20: mol_type = other DNA
cctgtcaaaaccagtcactc

SEQ ID NO: 2285 - DNA, 20 bp, synthetic construct
  source 1..20: mol_type = other DNA
ctaataatagtctaattaca

SEQ ID NO: 2286 - DNA, 20 bp, synthetic construct
  source 1..20: mol_type = other DNA
ttgtgcttttaaattcaaac

SEQ ID NO: 2287 - DNA, 20 bp, synthetic construct
  source 1..20: mol_type = other DNA
acatccttttaaatgttagg

SEQ ID NO: 2288 - DNA, 20 bp, synthetic construct
  source 1..20: mol_type = other DNA
tgtcttaatcaaacctcccg

SEQ ID NO: 2289 - DNA, 20 bp, synthetic construct
  source 1..20: mol_type = other DNA
cagttctatttttagttata

SEQ ID NO: 2290 - DNA, 20 bp, synthetic construct
  source 1..20: mol_type = other DNA
atttaccttctttaacacaa

SEQ ID NO: 2291 - DNA, 20 bp, synthetic construct
  source 1..20: mol_type = other DNA
gggatattttaaaattctac

SEQ ID NO: 2292 - DNA, 20 bp, synthetic construct
  source 1..20: mol_type = other DNA
cctgggtttcaaagattcct

SEQ ID NO: 2293 - DNA, 20 bp, synthetic construct
  source 1..20: mol_type = other DNA
tagagaattcaaagcaccaa

SEQ ID NO: 2294 - DNA, 20 bp, synthetic construct
  source 1..20: mol_type = other DNA
tcaaagttttaaagagtttt

SEQ ID NO: 2295 - DNA, 20 bp, synthetic construct
  source 1..20: mol_type = other DNA
tgctccaaacccagctcctc

SEQ ID NO: 2296 - DNA, 20 bp, synthetic construct
  source 1..20: mol_type = other DNA
ccctactccttttatagatg

SEQ ID NO: 2297 - DNA, 20 bp, synthetic construct
  source 1..20: mol_type = other DNA
tcatccaaacccagacgggt

SEQ ID NO: 2298 - DNA, 20 bp, synthetic construct
  source 1..20: mol_type = other DNA
ataaagtccttttaacccct

SEQ ID NO: 2299 - DNA, 20 bp, synthetic construct
  source 1..20: mol_type = other DNA
gtgcccttttaaaatctttt

SEQ ID NO: 2300 - DNA, 20 bp, synthetic construct
  source 1..20: mol_type = other DNA
agccaaaaatacatccacct

SEQ ID NO: 2301 - DNA, 20 bp, synthetic construct
  source 1..20: mol_type = other DNA
actgtaatctaaacaggcaa

SEQ ID NO: 2302 - DNA, 20 bp, synthetic construct
  source 1..20: mol_type = other DNA
ttcattacacacagcagaga

SEQ ID NO: 2303 - DNA, 20 bp, synthetic construct
  source 1..20: mol_type = other DNA
agacattatatatatgttgg

SEQ ID NO: 2304 - DNA, 20 bp, synthetic construct
  source 1..20: mol_type = other DNA
cccctacaccccagagcaca

SEQ ID NO: 2305 - DNA, 20 bp, synthetic construct
  source 1..20: mol_type = other DNA
gattgtattaaccacgcttt

SEQ ID NO: 2306 - DNA, 20 bp, synthetic construct
  source 1..20: mol_type = other DNA
tgaatgtcccaaatagcagc

SEQ ID NO: 2307 - DNA, 20 bp, synthetic construct
  source 1..20: mol_type = other DNA
cacccctaattcatgcagga

SEQ ID NO: 2308 - DNA, 20 bp, synthetic construct
  source 1..20: mol_type = other DNA
gccttcattctcaagctgaa

SEQ ID NO: 2309 - DNA, 20 bp, synthetic construct
  source 1..20: mol_type = other DNA
tttagctgtgatgatgtcag

SEQ ID NO: 2310 - DNA, 20 bp, synthetic construct
  source 1..20: mol_type = other DNA
tcaggcatcctcaagagtct

SEQ ID NO: 2311 - DNA, 20 bp, synthetic construct
  source 1..20: mol_type = other DNA
ctttagttcccatgaggtct

SEQ ID NO: 2312 - DNA, 20 bp, synthetic construct
  source 1..20: mol_type = other DNA
aagtggattatatttggcag

SEQ ID NO: 2313 - DNA, 20 bp, synthetic construct
  source 1..20: mol_type = other DNA
atcagctgcctctccttcca

SEQ ID NO: 2314 - DNA, 20 bp, synthetic construct
  source 1..20: mol_type = other DNA
ccaatacattttacaactcc

SEQ ID NO: 2315 - DNA, 20 bp, synthetic construct
  source 1..20: mol_type = other DNA
ggactgactctacaggctca

SEQ ID NO: 2316 - DNA, 20 bp, synthetic construct
  source 1..20: mol_type = other DNA
actgctttaaacaatagtct

SEQ ID NO: 2317 - DNA, 20 bp, synthetic construct
  source 1..20: mol_type = other DNA
tttttcttacacatggtagc

SEQ ID NO: 2318 - DNA, 20 bp, synthetic construct
  source 1..20: mol_type = other DNA
tcagcatgaaaaaaatcaga

SEQ ID NO: 2319 - DNA, 20 bp, synthetic construct
  source 1..20: mol_type = other DNA
agtccctgttttcacaaatt

SEQ ID NO: 2320 - DNA, 20 bp, synthetic construct
  source 1..20: mol_type = other DNA
gcttttaagaaaaattttag

SEQ ID NO: 2321 - DNA, 20 bp, synthetic construct
  source 1..20: mol_type = other DNA
ggatggcctttatacttttg

SEQ ID NO: 2322 - DNA, 20 bp, synthetic construct
  source 1..20: mol_type = other DNA
tcattttatgatcttgctgg

SEQ ID NO: 2323 - DNA, 20 bp, synthetic construct
  source 1..20: mol_type = other DNA
ctggttatcttcttatgcat

SEQ ID NO: 2324 - DNA, 20 bp, synthetic construct
  source 1..20: mol_type = other DNA
tttggaatcttttttgcctc

SEQ ID NO: 2325 - DNA, 20 bp, synthetic construct
  source 1..20: mol_type = other DNA
ctcttacatcacaaacatcc

SEQ ID NO: 2326 - DNA, 20 bp, synthetic construct
  source 1..20: mol_type = other DNA
gttcctaatgatacatttca

SEQ ID NO: 2327 - DNA, 20 bp, synthetic construct
  source 1..20: mol_type = other DNA
aatatatatcatcaaatctg

SEQ ID NO: 2328 - DNA, 20 bp, synthetic construct
  source 1..20: mol_type = other DNA
ttttctcctcactaattagt

SEQ ID NO: 2329 - DNA, 20 bp, synthetic construct
  source 1..20: mol_type = other DNA
agcctgccgaaaaattcacg

SEQ ID NO: 2330 - DNA, 20 bp, synthetic construct
  source 1..20: mol_type = other DNA
ccataaaaaccctccaacca

SEQ ID NO: 2331 - DNA, 20 bp, synthetic construct
  source 1..20: mol_type = other DNA
ctaggataattttatggcac

SEQ ID NO: 2332 - DNA, 20 bp, synthetic construct
  source 1..20: mol_type = other DNA
gcaggcaatatttaattttc

SEQ ID NO: 2333 - DNA, 20 bp, synthetic construct
  source 1..20: mol_type = other DNA
ggaaaccaatcccacatcaa

SEQ ID NO: 2334 - DNA, 20 bp, synthetic construct
  source 1..20: mol_type = other DNA
agtgtttgccttatagccac

SEQ ID NO: 2335 - DNA, 20 bp, synthetic construct
  source 1..20: mol_type = other DNA
ttgagtacattcatatggca

SEQ ID NO: 2336 - DNA, 20 bp, synthetic construct
  source 1..20: mol_type = other DNA
tgctaaagaaaaagaattgt

SEQ ID NO: 2337 - DNA, 20 bp, synthetic construct
  source 1..20: mol_type = other DNA
tttccagttgaatagacatg

SEQ ID NO: 2338 - DNA, 20 bp, synthetic construct
  source 1..20: mol_type = other DNA
aattactttcacaattttgc

SEQ ID NO: 2339 - DNA, 20 bp, synthetic construct
  source 1..20: mol_type = other DNA
ctctgaacaaaaatataagc

SEQ ID NO: 2340 - DNA, 20 bp, synthetic construct
  source 1..20: mol_type = other DNA
acacactataaatgaggctc

SEQ ID NO: 2341 - DNA, 20 bp, synthetic construct
  source 1..20: mol_type = other DNA
caggcttccctaaatgcagg

SEQ ID NO: 2342 - DNA, 20 bp, synthetic construct
  source 1..20: mol_type = other DNA
gctgcccgccaggccgtcgg

SEQ ID NO: 2343 - DNA, 20 bp, synthetic construct
  source 1..20: mol_type = other DNA
cccccccggcccatgccgat

SEQ ID NO: 2344 - DNA, 20 bp, synthetic construct
  source 1..20: mol_type = other DNA
tagtcatgaactataaacag

SEQ ID NO: 2345 - DNA, 20 bp, synthetic construct
  source 1..20: mol_type = other DNA
tcataattcacattcatccc

SEQ ID NO: 2346 - DNA, 20 bp, synthetic construct
  source 1..20: mol_type = other DNA
gaccaaaatgaattttcaaa

SEQ ID NO: 2347 - DNA, 20 bp, synthetic construct
  source 1..20: mol_type = other DNA
tatttaaaaatttctcccta

SEQ ID NO: 2348 - DNA, 20 bp, synthetic construct
  source 1..20: mol_type = other DNA
tcttaccatcaaaggctaaa

SEQ ID NO: 2349 - DNA, 20 bp, synthetic construct
  source 1..20: mol_type = other DNA
agctttaactatatagcaca

SEQ ID NO: 2350 - DNA, 20 bp, synthetic construct
  source 1..20: mol_type = other DNA
cctgactaatttcttggtga

SEQ ID NO: 2351 - DNA, 20 bp, synthetic construct
  source 1..20: mol_type = other DNA
aaaacccaacacactcacct

SEQ ID NO: 2352 - DNA, 20 bp, synthetic construct
  source 1..20: mol_type = other DNA
gacaaccaacacagctcaag

SEQ ID NO: 2353 - DNA, 20 bp, synthetic construct
  source 1..20: mol_type = other DNA
gtgctttataaaaaagtata

SEQ ID NO: 2354 - DNA, 20 bp, synthetic construct
  source 1..20: mol_type = other DNA
tcattgtttcaacagagcca

SEQ ID NO: 2355 - DNA, 20 bp, synthetic construct
  source 1..20: mol_type = other DNA
cgtgttcaagattatattct

SEQ ID NO: 2356 - DNA, 20 bp, synthetic construct
  source 1..20: mol_type = other DNA
agttagctaccagaacagtt

SEQ ID NO: 2357 - DNA, 20 bp, synthetic construct
  source 1..20: mol_type = other DNA
tgtcacctaatacttggtat

SEQ ID NO: 2358 - DNA, 20 bp, synthetic construct
  source 1..20: mol_type = other DNA
gtgcaaaacatcattccttc

SEQ ID NO: 2359 - DNA, 20 bp, synthetic construct
  source 1..20: mol_type = other DNA
aattcaataaacagactcga

SEQ ID NO: 2360 - DNA, 20 bp, synthetic construct
  source 1..20: mol_type = other DNA
ttcagaatttaaaattcagc

SEQ ID NO: 2361 - DNA, 20 bp, synthetic construct
  source 1..20: mol_type = other DNA
acaattagccaaaactgaat

SEQ ID NO: 2362 - DNA, 20 bp, synthetic construct
  source 1..20: mol_type = other DNA
cgttccaaattattcctgct

SEQ ID NO: 2363 - DNA, 20 bp, synthetic construct
  source 1..20: mol_type = other DNA
atttgctccttttatcattg

SEQ ID NO: 2364 - DNA, 20 bp, synthetic construct
  source 1..20: mol_type = other DNA
acattatttcaaaacccaca

SEQ ID NO: 2365 - DNA, 20 bp, synthetic construct
  source 1..20: mol_type = other DNA
tagtggttagattaacagct

SEQ ID NO: 2366 - DNA, 20 bp, synthetic construct
  source 1..20: mol_type = other DNA
gtctcataacgataaccaaa

SEQ ID NO: 2367 - DNA, 20 bp, synthetic construct
  source 1..20: mol_type = other DNA
acctttaaaattttttcagc

SEQ ID NO: 2368 - DNA, 20 bp, synthetic construct
  source 1..20: mol_type = other DNA
gcttacaaagccatagaacc

SEQ ID NO: 2369 - DNA, 20 bp, synthetic construct
  source 1..20: mol_type = other DNA
gtctacagcctttaacgact

SEQ ID NO: 2370 - DNA, 20 bp, synthetic construct
  source 1..20: mol_type = other DNA
ccagttaaccaaaaaatttt

SEQ ID NO: 2371 - DNA, 20 bp, synthetic construct
  source 1..20: mol_type = other DNA
ggctactatcaaatacattt

SEQ ID NO: 2372 - DNA, 20 bp, synthetic construct
  source 1..20: mol_type = other DNA
tgtttatttcaaactttccc

SEQ ID NO: 2373 - DNA, 20 bp, synthetic construct
  source 1..20: mol_type = other DNA
ggtcttggcccttaactgtt

SEQ ID NO: 2374 - DNA, 20 bp, synthetic construct
  source 1..20: mol_type = other DNA
ccctgataaatttatgaatt

SEQ ID NO: 2375 - DNA, 20 bp, synthetic construct
  source 1..20: mol_type = other DNA
tttgatctgccttatctctg

SEQ ID NO: 2376 - DNA, 20 bp, synthetic construct
  source 1..20: mol_type = other DNA
tttgtattttaaactgagtg

SEQ ID NO: 2377 - DNA, 20 bp, synthetic construct
  source 1..20: mol_type = other DNA
aagccaaaaatacatccacc

SEQ ID NO: 2378 - DNA, 20 bp, synthetic construct
  source 1..20: mol_type = other DNA
ctttttagaataccatgccc

SEQ ID NO: 2379 - DNA, 20 bp, synthetic construct
  source 1..20: mol_type = other DNA
aattcattacacacagcaga

SEQ ID NO: 2380 - DNA, 20 bp, synthetic construct
  source 1..20: mol_type = other DNA
aagacattatatatatgttg

SEQ ID NO: 2381 - DNA, 20 bp, synthetic construct
  source 1..20: mol_type = other DNA
aaggacagcccctacacccc

SEQ ID NO: 2382 - DNA, 20 bp, synthetic construct
  source 1..20: mol_type = other DNA
cagattgtattaaccacgct

SEQ ID NO: 2383 - DNA, 20 bp, synthetic construct
  source 1..20: mol_type = other DNA
tgttttattttatctgaatg

SEQ ID NO: 2384 - DNA, 20 bp, synthetic construct
  source 1..20: mol_type = other DNA
ccacccctaattcatgcagg

SEQ ID NO: 2385 - DNA, 20 bp, synthetic construct
  source 1..20: mol_type = other DNA
gctgccttcattctcaagct

SEQ ID NO: 2386 - DNA, 20 bp, synthetic construct
  source 1..20: mol_type = other DNA
ggtggagtattttagctgtg

SEQ ID NO: 2387 - DNA, 20 bp, synthetic construct
  source 1..20: mol_type = other DNA
ttatgagttcaggcatcctc

SEQ ID NO: 2388 - DNA, 20 bp, synthetic construct
  source 1..20: mol_type = other DNA
ggctttagttcccatgaggt

SEQ ID NO: 2389 - DNA, 20 bp, synthetic construct
  source 1..20: mol_type = other DNA
ttaagtggattatatttggc

SEQ ID NO: 2390 - DNA, 20 bp, synthetic construct
  source 1..20: mol_type = other DNA
ctagactttcatcagctgcc

SEQ ID NO: 2391 - DNA, 20 bp, synthetic construct
  source 1..20: mol_type = other DNA
accaatacattttacaactc

SEQ ID NO: 2392 - DNA, 20 bp, synthetic construct
  source 1..20: mol_type = other DNA
aagggactgactctacaggc

SEQ ID NO: 2393 - DNA, 20 bp, synthetic construct
  source 1..20: mol_type = other DNA
gacctctctctacttgctgt

SEQ ID NO: 2394 - DNA, 20 bp, synthetic construct
  source 1..20: mol_type = other DNA
tgggtttttcttacacatgg

SEQ ID NO: 2395 - DNA, 20 bp, synthetic construct
  source 1..20: mol_type = other DNA
gtcttgttttacctgtagag

SEQ ID NO: 2396 - DNA, 20 bp, synthetic construct
  source 1..20: mol_type = other DNA
catttccttcacaagagtcc

SEQ ID NO: 2397 - DNA, 20 bp, synthetic construct
  source 1..20: mol_type = other DNA
cctaatctgactaatgactg

SEQ ID NO: 2398 - DNA, 20 bp, synthetic construct
  source 1..20: mol_type = other DNA
agggatggcctttatacttt

SEQ ID NO: 2399 - DNA, 20 bp, synthetic construct
  source 1..20: mol_type = other DNA
aatcattaagtcattttatg

SEQ ID NO: 2400 - DNA, 20 bp, synthetic construct
  source 1..20: mol_type = other DNA
actggttatcttcttatgca

SEQ ID NO: 2401 - DNA, 20 bp, synthetic construct
  source 1..20: mol_type = other DNA
actctctccattcatttgga

SEQ ID NO: 2402 - DNA, 20 bp, synthetic construct
  source 1..20: mol_type = other DNA
tctcttacatcacaaacatc

SEQ ID NO: 2403 - DNA, 20 bp, synthetic construct
  source 1..20: mol_type = other DNA
tgagggttcctaatgataca

SEQ ID NO: 2404 - DNA, 20 bp, synthetic construct
  source 1..20: mol_type = other DNA
gtgagaatatatatcatcaa

SEQ ID NO: 2405 - DNA, 20 bp, synthetic construct
  source 1..20: mol_type = other DNA
cttgccagcccaatgctagt

SEQ ID NO: 2406 - DNA, 20 bp, synthetic construct
  source 1..20: mol_type = other DNA
catagctagaacagcctgcc

SEQ ID NO: 2407 - DNA, 20 bp, synthetic construct
  source 1..20: mol_type = other DNA
cccataaaaaccctccaacc

SEQ ID NO: 2408 - DNA, 20 bp, synthetic construct
  source 1..20: mol_type = other DNA
gctaggataattttatggca

SEQ ID NO: 2409 - DNA, 20 bp, synthetic construct
  source 1..20: mol_type = other DNA
tatacacacttcacagggca

SEQ ID NO: 2410 - DNA, 20 bp, synthetic construct
  source 1..20: mol_type = other DNA
cagaaggaaaccaatcccac

SEQ ID NO: 2411 - DNA, 20 bp, synthetic construct
  source 1..20: mol_type = other DNA
cagtgtttgccttatagcca

SEQ ID NO: 2412 - DNA, 20 bp, synthetic construct
  source 1..20: mol_type = other DNA
aacttgagtacattcatatg

SEQ ID NO: 2413 - DNA, 20 bp, synthetic construct
  source 1..20: mol_type = other DNA
tggaatatctttacagtgct

SEQ ID NO: 2414 - DNA, 20 bp, synthetic construct
  source 1..20: mol_type = other DNA
cactgaaatcaagaatgcaa

SEQ ID NO: 2415 - DNA, 20 bp, synthetic construct
  source 1..20: mol_type = other DNA
tgaattactttcacaatttt

SEQ ID NO: 2416 - DNA, 20 bp, synthetic construct
  source 1..20: mol_type = other DNA
aactctgaacaaaaatataa

SEQ ID NO: 2417 - DNA, 20 bp, synthetic construct
  source 1..20: mol_type = other DNA
agccacacactataaatgag

SEQ ID NO: 2418 - DNA, 20 bp, synthetic construct
  source 1..20: mol_type = other DNA
ccaggcttccctaaatgcag

SEQ ID NO: 2419 - DNA, 20 bp, synthetic construct
  source 1..20: mol_type = other DNA
attccgttttcctgctcggc

SEQ ID NO: 2420 - DNA, 20 bp, synthetic construct
  source 1..20: mol_type = other DNA
ctgctctgaacccccccggc

SEQ ID NO: 2421 - DNA, 20 bp, synthetic construct
  source 1..20: mol_type = other DNA
ttgtccatagtcatgaacta

SEQ ID NO: 2422 - DNA, 20 bp, synthetic construct
  source 1..20: mol_type = other DNA
ttcataattcacattcatcc

SEQ ID NO: 2423 - DNA, 20 bp, synthetic construct
  source 1..20: mol_type = other DNA
gatgtggtaaaaagaccaaa

SEQ ID NO: 2424 - DNA, 20 bp, synthetic construct
  source 1..20: mol_type = other DNA
atatttaaaaatttctccct

SEQ ID NO: 2425 - DNA, 20 bp, synthetic construct
  source 1..20: mol_type = other DNA
cctcttaccatcaaaggcta

SEQ ID NO: 2426 - DNA, 20 bp, synthetic construct
  source 1..20: mol_type = other DNA
gagctttaactatatagcac

SEQ ID NO: 2427 - DNA, 20 bp, synthetic construct
  source 1..20: mol_type = other DNA
ttcgccctgactaatttctt

SEQ ID NO: 2428 - DNA, 20 bp, synthetic construct
  source 1..20: mol_type = other DNA
ggatgctgccacttcctggt

SEQ ID NO: 2429 - DNA, 20 bp, synthetic construct
  source 1..20: mol_type = other DNA
ccatgacaaccaacacagct

SEQ ID NO: 2430 - DNA, 20 bp, synthetic construct
  source 1..20: mol_type = other DNA
ccaacccaacacaatagcag

SEQ ID NO: 2431 - DNA, 20 bp, synthetic construct
  source 1..20: mol_type = other DNA
actcattgtttcaacagagc

SEQ ID NO: 2432 - DNA, 20 bp, synthetic construct
  source 1..20: mol_type = other DNA
cccttgttacaaacacttcg

SEQ ID NO: 2433 - DNA, 20 bp, synthetic construct
  source 1..20: mol_type = other DNA
ccctcccgccattacacagg

SEQ ID NO: 2434 - DNA, 20 bp, synthetic construct
  source 1..20: mol_type = other DNA
tagtgtcacctaatacttgg

SEQ ID NO: 2435 - DNA, 20 bp, synthetic construct
  source 1..20: mol_type = other DNA
ggtgcaaaacatcattcctt

SEQ ID NO: 2436 - DNA, 20 bp, synthetic construct
  source 1..20: mol_type = other DNA
ccataaaattcaataaacag

SEQ ID NO: 2437 - DNA, 20 bp, synthetic construct
  source 1..20: mol_type = other DNA
ataagctttctttaaatgca

SEQ ID NO: 2438 - DNA, 20 bp, synthetic construct
  source 1..20: mol_type = other DNA
gtgttctttctttaacagtt

SEQ ID NO: 2439 - DNA, 20 bp, synthetic construct
  source 1..20: mol_type = other DNA
cccccgttccaaattattcc

SEQ ID NO: 2440 - DNA, 20 bp, synthetic construct
  source 1..20: mol_type = other DNA
gtttttatccattacaagag

SEQ ID NO: 2441 - DNA, 20 bp, synthetic construct
  source 1..20: mol_type = other DNA
acccgcaatcaaatactgcc

SEQ ID NO: 2442 - DNA, 20 bp, synthetic construct
  source 1..20: mol_type = other DNA
ctaatgtgcccttaacatgg

SEQ ID NO: 2443 - DNA, 20 bp, synthetic construct
  source 1..20: mol_type = other DNA
gctcataaaaccatgtgctc

SEQ ID NO: 2444 - DNA, 20 bp, synthetic construct
  source 1..20: mol_type = other DNA
gcttgattttaaactttata

SEQ ID NO: 2445 - DNA, 20 bp, synthetic construct
  source 1..20: mol_type = other DNA
accctcaaacgaataggctc

SEQ ID NO: 2446 - DNA, 20 bp, synthetic construct
  source 1..20: mol_type = other DNA
tccacacaagaataatctac

SEQ ID NO: 2447 - DNA, 20 bp, synthetic construct
  source 1..20: mol_type = other DNA
gctaggaaaatttaccatac

SEQ ID NO: 2448 - DNA, 20 bp, synthetic construct
  source 1..20: mol_type = other DNA
gattaaataatttaagcaca

SEQ ID NO: 2449 - DNA, 20 bp, synthetic construct
  source 1..20: mol_type = other DNA
tcttgggttccttatattac

SEQ ID NO: 2450 - DNA, 20 bp, synthetic construct
  source 1..20: mol_type = other DNA
taggtgtttatttagaaccc

SEQ ID NO: 2451 - DNA, 20 bp, synthetic construct
  source 1..20: mol_type = other DNA
tcatgctttcaaaacacagt

SEQ ID NO: 2452 - DNA, 20 bp, synthetic construct
  source 1..20: mol_type = other DNA
aatgaaatcatttactgaac

SEQ ID NO: 2453 - DNA, 20 bp, synthetic construct
  source 1..20: mol_type = other DNA
agtgtaatacattactcata

SEQ ID NO: 2454 - DNA, 20 bp, synthetic construct
  source 1..20: mol_type = other DNA
gtatacaaagatataacctg

SEQ ID NO: 2455 - DNA, 20 bp, synthetic construct
  source 1..20: mol_type = other DNA
tgtttgttttaaaattaggg

SEQ ID NO: 2456 - DNA, 20 bp, synthetic construct
  source 1..20: mol_type = other DNA
ggttaattcattacacacag

SEQ ID NO: 2457 - DNA, 20 bp, synthetic construct
  source 1..20: mol_type = other DNA
acctaaataataagacatta

SEQ ID NO: 2458 - DNA, 20 bp, synthetic construct
  source 1..20: mol_type = other DNA
agccagacaactaaggacag

SEQ ID NO: 2459 - DNA, 20 bp, synthetic construct
  source 1..20: mol_type = other DNA
tcagattgtattaaccacgc

SEQ ID NO: 2460 - DNA, 20 bp, synthetic construct
  source 1..20: mol_type = other DNA
ttgttttattttatctgaat

SEQ ID NO: 2461 - DNA, 20 bp, synthetic construct
  source 1..20: mol_type = other DNA
gtacccacccctaattcatg

SEQ ID NO: 2462 - DNA, 20 bp, synthetic construct
  source 1..20: mol_type = other DNA
tggctgccttcattctcaag

SEQ ID NO: 2463 - DNA, 20 bp, synthetic construct
  source 1..20: mol_type = other DNA
tgtggcaaacacagctggtg

SEQ ID NO: 2464 - DNA, 20 bp, synthetic construct
  source 1..20: mol_type = other DNA
atactatatcacactgcttt

SEQ ID NO: 2465 - DNA, 20 bp, synthetic construct
  source 1..20: mol_type = other DNA
gttttatatgccatggcttt

SEQ ID NO: 2466 - DNA, 20 bp, synthetic construct
  source 1..20: mol_type = other DNA
tggaggatattaagtggatt

SEQ ID NO: 2467 - DNA, 20 bp, synthetic construct
  source 1..20: mol_type = other DNA
tctagactttcatcagctgc

SEQ ID NO: 2468 - DNA, 20 bp, synthetic construct
  source 1..20: mol_type = other DNA
ttaccaatacattttacaac

SEQ ID NO: 2469 - DNA, 20 bp, synthetic construct
  source 1..20: mol_type = other DNA
ggcatgttcaatgttggcaa

SEQ ID NO: 2470 - DNA, 20 bp, synthetic construct
  source 1..20: mol_type = other DNA
acagggaaaactgttaggtg

SEQ ID NO: 2471 - DNA, 20 bp, synthetic construct
  source 1..20: mol_type = other DNA
ctgggtttttcttacacatg

SEQ ID NO: 2472 - DNA, 20 bp, synthetic construct
  source 1..20: mol_type = other DNA
cagtcttgttttacctgtag

SEQ ID NO: 2473 - DNA, 20 bp, synthetic construct
  source 1..20: mol_type = other DNA
ctcccatttccttcacaaga

SEQ ID NO: 2474 - DNA, 20 bp, synthetic construct
  source 1..20: mol_type = other DNA
gtcaccttcctaatctgact

SEQ ID NO: 2475 - DNA, 20 bp, synthetic construct
  source 1..20: mol_type = other DNA
cctttataacttttctttct

SEQ ID NO: 2476 - DNA, 20 bp, synthetic construct
  source 1..20: mol_type = other DNA
gttagtaatcattaagtcat

SEQ ID NO: 2477 - DNA, 20 bp, synthetic construct
  source 1..20: mol_type = other DNA
ccctggtgccaaaagggact

SEQ ID NO: 2478 - DNA, 20 bp, synthetic construct
  source 1..20: mol_type = other DNA
tctttaacccctcttgcgcc

SEQ ID NO: 2479 - DNA, 20 bp, synthetic construct
  source 1..20: mol_type = other DNA
tttctcttacatcacaaaca

SEQ ID NO: 2480 - DNA, 20 bp, synthetic construct
  source 1..20: mol_type = other DNA
ttgagggttcctaatgatac

SEQ ID NO: 2481 - DNA, 20 bp, synthetic construct
  source 1..20: mol_type = other DNA
agtgagaatatatatcatca

SEQ ID NO: 2482 - DNA, 20 bp, synthetic construct
  source 1..20: mol_type = other DNA
aatctgatcattgtaggcac

SEQ ID NO: 2483 - DNA, 20 bp, synthetic construct
  source 1..20: mol_type = other DNA
tggtgtgaaccatagctaga

SEQ ID NO: 2484 - DNA, 20 bp, synthetic construct
  source 1..20: mol_type = other DNA
acccccctcccataaaaacc

SEQ ID NO: 2485 - DNA, 20 bp, synthetic construct
  source 1..20: mol_type = other DNA
ggttttaccctttcctgcac

SEQ ID NO: 2486 - DNA, 20 bp, synthetic construct
  source 1..20: mol_type = other DNA
cacattatacacacttcaca

SEQ ID NO: 2487 - DNA, 20 bp, synthetic construct
  source 1..20: mol_type = other DNA
tcattaacaacataaactga

SEQ ID NO: 2488 - DNA, 20 bp, synthetic construct
  source 1..20: mol_type = other DNA
catggtacagataattgtga

SEQ ID NO: 2489 - DNA, 20 bp, synthetic construct
  source 1..20: mol_type = other DNA
tactggatccatacaaggca

SEQ ID NO: 2490 - DNA, 20 bp, synthetic construct
  source 1..20: mol_type = other DNA
atggaatatctttacagtgc

SEQ ID NO: 2491 - DNA, 20 bp, synthetic construct
  source 1..20: mol_type = other DNA
ccactgaaatcaagaatgca

SEQ ID NO: 2492 - DNA, 20 bp, synthetic construct
  source 1..20: mol_type = other DNA
tcttgaattactttcacaat

SEQ ID NO: 2493 - DNA, 20 bp, synthetic construct
  source 1..20: mol_type = other DNA
gaggacaactaaaaactctg

SEQ ID NO: 2494 - DNA, 20 bp, synthetic construct
  source 1..20: mol_type = other DNA
cagccacacactataaatga

SEQ ID NO: 2495 - DNA, 20 bp, synthetic construct
  source 1..20: mol_type = other DNA
gccaggcttccctaaatgca

SEQ ID NO: 2496 - DNA, 20 bp, synthetic construct
  source 1..20: mol_type = other DNA
tcgccattctcagagagcat

SEQ ID NO: 2497 - DNA, 20 bp, synthetic construct
  source 1..20: mol_type = other DNA
tgggaaccccaggaggacac

SEQ ID NO: 2498 - DNA, 20 bp, synthetic construct
  source 1..20: mol_type = other DNA
atctaattcctcatgtcaca

SEQ ID NO: 2499 - DNA, 20 bp, synthetic construct
  source 1..20: mol_type = other DNA
gttcataattcacattcatc

SEQ ID NO: 2500 - DNA, 20 bp, synthetic construct
  source 1..20: mol_type = other DNA
cagagtttctaagagcccgc

SEQ ID NO: 2501 - DNA, 20 bp, synthetic construct
  source 1..20: mol_type = other DNA
aatatttaaaaatttctccc

SEQ ID NO: 2502 - DNA, 20 bp, synthetic construct
  source 1..20: mol_type = other DNA
ttcctcttaccatcaaaggc

SEQ ID NO: 2503 - DNA, 20 bp, synthetic construct
  source 1..20: mol_type = other DNA
atgagctttaactatatagc

SEQ ID NO: 2504 - DNA, 20 bp, synthetic construct
  source 1..20: mol_type = other DNA
tcttttcgccctgactaatt

SEQ ID NO: 2505 - DNA, 20 bp, synthetic construct
  source 1..20: mol_type = other DNA
aagaggtgtgaaaggttccg

SEQ ID NO: 2506 - DNA, 20 bp, synthetic construct
  source 1..20: mol_type = other DNA
gccatgacaaccaacacagc

SEQ ID NO: 2507 - DNA, 20 bp, synthetic construct
  source 1..20: mol_type = other DNA
ggaaaccaacccaacacaat

SEQ ID NO: 2508 - DNA, 20 bp, synthetic construct
  source 1..20: mol_type = other DNA
actttcaacccttctctgct

SEQ ID NO: 2509 - DNA, 20 bp, synthetic construct
  source 1..20: mol_type = other DNA
atcccttgttacaaacactt

SEQ ID NO: 2510 - DNA, 20 bp, synthetic construct
  source 1..20: mol_type = other DNA
tccctcccgccattacacag

SEQ ID NO: 2511 - DNA, 20 bp, synthetic construct
  source 1..20: mol_type = other DNA
tgagctagtgtcacctaata

SEQ ID NO: 2512 - DNA, 20 bp, synthetic construct
  source 1..20: mol_type = other DNA
aggtgcaaaacatcattcct

SEQ ID NO: 2513 - DNA, 20 bp, synthetic construct
  source 1..20: mol_type = other DNA
agggaccataaaattcaata

SEQ ID NO: 2514 - DNA, 20 bp, synthetic construct
  source 1..20: mol_type = other DNA
ctcctccaaatttatcttca

SEQ ID NO: 2515 - DNA, 20 bp, synthetic construct
  source 1..20: mol_type = other DNA
cacaaaatacattaagtcct

SEQ ID NO: 2516 - DNA, 20 bp, synthetic construct
  source 1..20: mol_type = other DNA
tccagcaaaatatttcttta

SEQ ID NO: 2517 - DNA, 20 bp, synthetic construct
  source 1..20: mol_type = other DNA
ttgatcaaccaaagatggct

SEQ ID NO: 2518 - DNA, 20 bp, synthetic construct
  source 1..20: mol_type = other DNA
ccaatggctttttaacagat

SEQ ID NO: 2519 - DNA, 20 bp, synthetic construct
  source 1..20: mol_type = other DNA
aacacattagattatgagta

SEQ ID NO: 2520 - DNA, 20 bp, synthetic construct
  source 1..20: mol_type = other DNA
agggtgttattttagagtaa

SEQ ID NO: 2521 - DNA, 20 bp, synthetic construct
  source 1..20: mol_type = other DNA
gctggaaaagaatctgagca

SEQ ID NO: 2522 - DNA, 20 bp, synthetic construct
  source 1..20: mol_type = other DNA
gttatattattttatccctt

SEQ ID NO: 2523 - DNA, 20 bp, synthetic construct
  source 1..20: mol_type = other DNA
gaagatatcttttatgacac

SEQ ID NO: 2524 - DNA, 20 bp, synthetic construct
  source 1..20: mol_type = other DNA
cacagtagccaaaagcagtc

SEQ ID NO: 2525 - DNA, 20 bp, synthetic construct
  source 1..20: mol_type = other DNA
gtatatattatttaaaatgt

SEQ ID NO: 2526 - DNA, 20 bp, synthetic construct
  source 1..20: mol_type = other DNA
agctggtttctttagccacc

SEQ ID NO: 2527 - DNA, 20 bp, synthetic construct
  source 1..20: mol_type = other DNA
gactgaaaaatacccagcca

SEQ ID NO: 2528 - DNA, 20 bp, synthetic construct
  source 1..20: mol_type = other DNA
taggccttattttattccat

SEQ ID NO: 2529 - DNA, 20 bp, synthetic construct
  source 1..20: mol_type = other DNA
tgagctttttaaaaacagtt

SEQ ID NO: 2530 - DNA, 20 bp, synthetic construct
  source 1..20: mol_type = other DNA
tttcttagccaaagagatat

SEQ ID NO: 2531 - DNA, 20 bp, synthetic construct
  source 1..20: mol_type = other DNA
tgttcaatttaaaagccttg

SEQ ID NO: 2532 - DNA, 20 bp, synthetic construct
  source 1..20: mol_type = other DNA
atctgcaaagaatctgcccc

SEQ ID NO: 2533 - DNA, 20 bp, synthetic construct
  source 1..20: mol_type = other DNA
aggttaattcattacacaca

SEQ ID NO: 2534 - DNA, 20 bp, synthetic construct
  source 1..20: mol_type = other DNA
tcatacctaaataataagac

SEQ ID NO: 2535 - DNA, 20 bp, synthetic construct
  source 1..20: mol_type = other DNA
cagccagacaactaaggaca

SEQ ID NO: 2536 - DNA, 20 bp, synthetic construct
  source 1..20: mol_type = other DNA
cctgacttctcagattgtat

SEQ ID NO: 2537 - DNA, 20 bp, synthetic construct
  source 1..20: mol_type = other DNA
attcaaaccattaattagtt

SEQ ID NO: 2538 - DNA, 20 bp, synthetic construct
  source 1..20: mol_type = other DNA
agtacccacccctaattcat

SEQ ID NO: 2539 - DNA, 20 bp, synthetic construct
  source 1..20: mol_type = other DNA
agtggctgccttcattctca

SEQ ID NO: 2540 - DNA, 20 bp, synthetic construct
  source 1..20: mol_type = other DNA
gactctgaacctgtcacttg

SEQ ID NO: 2541 - DNA, 20 bp, synthetic construct
  source 1..20: mol_type = other DNA
ccatactatatcacactgct

SEQ ID NO: 2542 - DNA, 20 bp, synthetic construct
  source 1..20: mol_type = other DNA
ctcagttttatatgccatgg

SEQ ID NO: 2543 - DNA, 20 bp, synthetic construct
  source 1..20: mol_type = other DNA
ttggaggatattaagtggat

SEQ ID NO: 2544 - DNA, 20 bp, synthetic construct
  source 1..20: mol_type = other DNA
ttctagactttcatcagctg

SEQ ID NO: 2545 - DNA, 20 bp, synthetic construct
  source 1..20: mol_type = other DNA
ctttaccaatacattttaca

SEQ ID NO: 2546 - DNA, 20 bp, synthetic construct
  source 1..20: mol_type = other DNA
attcatcgccaccaagctcg

SEQ ID NO: 2547 - DNA, 20 bp, synthetic construct
  source 1..20: mol_type = other DNA
atctatcacaccaatgcaag

SEQ ID NO: 2548 - DNA, 20 bp, synthetic construct
  source 1..20: mol_type = other DNA
gctgggtttttcttacacat

SEQ ID NO: 2549 - DNA, 20 bp, synthetic construct
  source 1..20: mol_type = other DNA
agtgaaattctcagtcttgt

SEQ ID NO: 2550 - DNA, 20 bp, synthetic construct
  source 1..20: mol_type = other DNA
gttgtttaaatatgtctccc

SEQ ID NO: 2551 - DNA, 20 bp, synthetic construct
  source 1..20: mol_type = other DNA
tgtcaccttcctaatctgac

SEQ ID NO: 2552 - DNA, 20 bp, synthetic construct
  source 1..20: mol_type = other DNA
gcctttataacttttctttc

SEQ ID NO: 2553 - DNA, 20 bp, synthetic construct
  source 1..20: mol_type = other DNA
tgttagtaatcattaagtca

SEQ ID NO: 2554 - DNA, 20 bp, synthetic construct
  source 1..20: mol_type = other DNA
ccaaaaaatcttcttccatg

SEQ ID NO: 2555 - DNA, 20 bp, synthetic construct
  source 1..20: mol_type = other DNA
ttctttaacccctcttgcgc

SEQ ID NO: 2556 - DNA, 20 bp, synthetic construct
  source 1..20: mol_type = other DNA
cttggaatcatactttcttc

SEQ ID NO: 2557 - DNA, 20 bp, synthetic construct
  source 1..20: mol_type = other DNA
attgagggttcctaatgata

SEQ ID NO: 2558 - DNA, 20 bp, synthetic construct
  source 1..20: mol_type = other DNA
tcagtgagaatatatatcat

SEQ ID NO: 2559 - DNA, 20 bp, synthetic construct
  source 1..20: mol_type = other DNA
cagataatctgatcattgta

SEQ ID NO: 2560 - DNA, 20 bp, synthetic construct
  source 1..20: mol_type = other DNA
gtggtgtgaaccatagctag

SEQ ID NO: 2561 - DNA, 20 bp, synthetic construct
  source 1..20: mol_type = other DNA
ccccccatacccccctccca

SEQ ID NO: 2562 - DNA, 20 bp, synthetic construct
  source 1..20: mol_type = other DNA
gggttttaccctttcctgca

SEQ ID NO: 2563 - DNA, 20 bp, synthetic construct
  source 1..20: mol_type = other DNA
gccacattatacacacttca

SEQ ID NO: 2564 - DNA, 20 bp, synthetic construct
  source 1..20: mol_type = other DNA
gtcattaacaacataaactg

SEQ ID NO: 2565 - DNA, 20 bp, synthetic construct
  source 1..20: mol_type = other DNA
ccatggtacagataattgtg

SEQ ID NO: 2566 - DNA, 20 bp, synthetic construct
  source 1..20: mol_type = other DNA
ctgatacatttctagaatga

SEQ ID NO: 2567 - DNA, 20 bp, synthetic construct
  source 1..20: mol_type = other DNA
tcacagtttacatctcaaca

SEQ ID NO: 2568 - DNA, 20 bp, synthetic construct
  source 1..20: mol_type = other DNA
tagaattaaaatatacacca

SEQ ID NO: 2569 - DNA, 20 bp, synthetic construct
  source 1..20: mol_type = other DNA
gtcttgaattactttcacaa

SEQ ID NO: 2570 - DNA, 20 bp, synthetic construct
  source 1..20: mol_type = other DNA
tggaccaaccctccttctga

SEQ ID NO: 2571 - DNA, 20 bp, synthetic construct
  source 1..20: mol_type = other DNA
tcccccagccacacactata

SEQ ID NO: 2572 - DNA, 20 bp, synthetic construct
  source 1..20: mol_type = other DNA
tcaggtagccgatgacaggg

SEQ ID NO: 2573 - DNA, 20 bp, synthetic construct
  source 1..20: mol_type = other DNA
ttcgccattctcagagagca

SEQ ID NO: 2574 - DNA, 20 bp, synthetic construct
  source 1..20: mol_type = other DNA
gctgggttcctgatgttgat

SEQ ID NO: 2575 - DNA, 20 bp, synthetic construct
  source 1..20: mol_type = other DNA
aatctaattcctcatgtcac

SEQ ID NO: 2576 - DNA, 20 bp, synthetic construct
  source 1..20: mol_type = other DNA
agttcataattcacattcat

SEQ ID NO: 2577 - DNA, 20 bp, synthetic construct
  source 1..20: mol_type = other DNA
tcagagtttctaagagcccg

SEQ ID NO: 2578 - DNA, 20 bp, synthetic construct
  source 1..20: mol_type = other DNA
gcagccatccaagtaagaat

SEQ ID NO: 2579 - DNA, 20 bp, synthetic construct
  source 1..20: mol_type = other DNA
gcccgtattcctcttaccat

SEQ ID NO: 2580 - DNA, 20 bp, synthetic construct
  source 1..20: mol_type = other DNA
ggaagatcaaccaaacaagg

SEQ ID NO: 2581 - DNA, 20 bp, synthetic construct
  source 1..20: mol_type = other DNA
gtattatttttttcttttcg

SEQ ID NO: 2582 - DNA, 20 bp, synthetic construct
  source 1..20: mol_type = other DNA
cagagcagtcaaagtgctgc

SEQ ID NO: 2583 - DNA, 20 bp, synthetic construct
  source 1..20: mol_type = other DNA
agccatgacaaccaacacag

SEQ ID NO: 2584 - DNA, 20 bp, synthetic construct
  source 1..20: mol_type = other DNA
aagagaggaaaccaacccaa

SEQ ID NO: 2585 - DNA, 20 bp, synthetic construct
  source 1..20: mol_type = other DNA
aactttcaacccttctctgc

SEQ ID NO: 2586 - DNA, 20 bp, synthetic construct
  source 1..20: mol_type = other DNA
ataatgagtcctgtttgatt

SEQ ID NO: 2587 - DNA, 20 bp, synthetic construct
  source 1..20: mol_type = other DNA
ccggtgttccctcccgccat

SEQ ID NO: 2588 - DNA, 20 bp, synthetic construct
  source 1..20: mol_type = other DNA
cagagaaaacctgtgcaccg

SEQ ID NO: 2589 - DNA, 20 bp, synthetic construct
  source 1..20: mol_type = other DNA
aaggtgcaaaacatcattcc

SEQ ID NO: 2590 - DNA, 20 bp, synthetic construct
  source 1..20: mol_type = other DNA
aagcaccatcaaagaaaggg

SEQ ID NO: 2591 - DNA, 20 bp, synthetic construct
  source 1..20: mol_type = other DNA
acccaatttcaaagatcact

SEQ ID NO: 2592 - DNA, 20 bp, synthetic construct
  source 1..20: mol_type = other DNA
gttcacaaaatacattaagt

SEQ ID NO: 2593 - DNA, 20 bp, synthetic construct
  source 1..20: mol_type = other DNA
agatcaattcaaaggctcct

SEQ ID NO: 2594 - DNA, 20 bp, synthetic construct
  source 1..20: mol_type = other DNA
gatttgtatttttaattgac

SEQ ID NO: 2595 - DNA, 20 bp, synthetic construct
  source 1..20: mol_type = other DNA
ttgacattttaaaacagctc

SEQ ID NO: 2596 - DNA, 20 bp, synthetic construct
  source 1..20: mol_type = other DNA
aagcttatccaaaaacattt

SEQ ID NO: 2597 - DNA, 20 bp, synthetic construct
  source 1..20: mol_type = other DNA
cccctcaaccaaacttttac

SEQ ID NO: 2598 - DNA, 20 bp, synthetic construct
  source 1..20: mol_type = other DNA
tattaatttcattaccatga

SEQ ID NO: 2599 - DNA, 20 bp, synthetic construct
  source 1..20: mol_type = other DNA
cctagaatacattattcctc

SEQ ID NO: 2600 - DNA, 20 bp, synthetic construct
  source 1..20: mol_type = other DNA
agcatattttaaagaagaag

SEQ ID NO: 2601 - DNA, 20 bp, synthetic construct
  source 1..20: mol_type = other DNA
gtccatacaccttaataagt

SEQ ID NO: 2602 - DNA, 20 bp, synthetic construct
  source 1..20: mol_type = other DNA
gattacttttaaaagcaaca

SEQ ID NO: 2603 - DNA, 20 bp, synthetic construct
  source 1..20: mol_type = other DNA
cctaaaagaatttatccata

SEQ ID NO: 2604 - DNA, 20 bp, synthetic construct
  source 1..20: mol_type = other DNA
cttggcaaattattatctgc

SEQ ID NO: 2605 - DNA, 20 bp, synthetic construct
  source 1..20: mol_type = other DNA
gctaagaaaatataggcctt

SEQ ID NO: 2606 - DNA, 20 bp, synthetic construct
  source 1..20: mol_type = other DNA
ggctttatagtctaagttgc

SEQ ID NO: 2607 - DNA, 20 bp, synthetic construct
  source 1..20: mol_type = other DNA
acttcaaacctttatcagtt

SEQ ID NO: 2608 - DNA, 20 bp, synthetic construct
  source 1..20: mol_type = other DNA
caaacccaaatttagctctg

SEQ ID NO: 2609 - DNA, 20 bp, synthetic construct
  source 1..20: mol_type = other DNA
cctttaagcccttaaagctg

SEQ ID NO: 2610 - DNA, 20 bp, synthetic construct
  source 1..20: mol_type = other DNA
gaggttaattcattacacac

SEQ ID NO: 2611 - DNA, 20 bp, synthetic construct
  source 1..20: mol_type = other DNA
ggccttatcatacctaaata

SEQ ID NO: 2612 - DNA, 20 bp, synthetic construct
  source 1..20: mol_type = other DNA
accagcagccagacaactaa

SEQ ID NO: 2613 - DNA, 20 bp, synthetic construct
  source 1..20: mol_type = other DNA
taccccaagcccagcaggtc

SEQ ID NO: 2614 - DNA, 20 bp, synthetic construct
  source 1..20: mol_type = other DNA
ccaaaacaattcaaaccatt

SEQ ID NO: 2615 - DNA, 20 bp, synthetic construct
  source 1..20: mol_type = other DNA
tttctcctagtacccacccc

SEQ ID NO: 2616 - DNA, 20 bp, synthetic construct
  source 1..20: mol_type = other DNA
aagtggctgccttcattctc

SEQ ID NO: 2617 - DNA, 20 bp, synthetic construct
  source 1..20: mol_type = other DNA
ggaacctcaattaagtccag

SEQ ID NO: 2618 - DNA, 20 bp, synthetic construct
  source 1..20: mol_type = other DNA
caccatactatatcacactg

SEQ ID NO: 2619 - DNA, 20 bp, synthetic construct
  source 1..20: mol_type = other DNA
cctcagttttatatgccatg

SEQ ID NO: 2620 - DNA, 20 bp, synthetic construct
  source 1..20: mol_type = other DNA
ttatggcctcaaacttggag

SEQ ID NO: 2621 - DNA, 20 bp, synthetic construct
  source 1..20: mol_type = other DNA
tctttctagactttcatcag

SEQ ID NO: 2622 - DNA, 20 bp, synthetic construct
  source 1..20: mol_type = other DNA
cactttaccaatacatttta

SEQ ID NO: 2623 - DNA, 20 bp, synthetic construct
  source 1..20: mol_type = other DNA
ttaggattcatcgccaccaa

SEQ ID NO: 2624 - DNA, 20 bp, synthetic construct
  source 1..20: mol_type = other DNA
ccaatctatcacaccaatgc

SEQ ID NO: 2625 - DNA, 20 bp, synthetic construct
  source 1..20: mol_type = other DNA
tcccacattaaaagctgggt

SEQ ID NO: 2626 - DNA, 20 bp, synthetic construct
  source 1..20: mol_type = other DNA
tctgcaagtgaaattctcag

SEQ ID NO: 2627 - DNA, 20 bp, synthetic construct
  source 1..20: mol_type = other DNA
gtacatatcaccaaaaacaa

SEQ ID NO: 2628 - DNA, 20 bp, synthetic construct
  source 1..20: mol_type = other DNA
atgtcaccttcctaatctga

SEQ ID NO: 2629 - DNA, 20 bp, synthetic construct
  source 1..20: mol_type = other DNA
aatagcctttataacttttc

SEQ ID NO: 2630 - DNA, 20 bp, synthetic construct
  source 1..20: mol_type = other DNA
tgtgttagtaatcattaagt

SEQ ID NO: 2631 - DNA, 20 bp, synthetic construct
  source 1..20: mol_type = other DNA
ctgccaaaaaatcttcttcc

SEQ ID NO: 2632 - DNA, 20 bp, synthetic construct
  source 1..20: mol_type = other DNA
tgctggttctttaacccctc

SEQ ID NO: 2633 - DNA, 20 bp, synthetic construct
  source 1..20: mol_type = other DNA
gctgttcaatcaagcacctt

SEQ ID NO: 2634 - DNA, 20 bp, synthetic construct
  source 1..20: mol_type = other DNA
ctcaaaatattattgagggt

SEQ ID NO: 2635 - DNA, 20 bp, synthetic construct
  source 1..20: mol_type = other DNA
tctcagtgagaatatatatc

SEQ ID NO: 2636 - DNA, 20 bp, synthetic construct
  source 1..20: mol_type = other DNA
tcagataatctgatcattgt

SEQ ID NO: 2637 - DNA, 20 bp, synthetic construct
  source 1..20: mol_type = other DNA
cttagaattaaatgctgtgg

SEQ ID NO: 2638 - DNA, 20 bp, synthetic construct
  source 1..20: mol_type = other DNA
gtctccccccatacccccct

SEQ ID NO: 2639 - DNA, 20 bp, synthetic construct
  source 1..20: mol_type = other DNA
aactccaaagacaccactct

SEQ ID NO: 2640 - DNA, 20 bp, synthetic construct
  source 1..20: mol_type = other DNA
agccacattatacacacttc

SEQ ID NO: 2641 - DNA, 20 bp, synthetic construct
  source 1..20: mol_type = other DNA
tcttagagtcattaacaaca

SEQ ID NO: 2642 - DNA, 20 bp, synthetic construct
  source 1..20: mol_type = other DNA
tgggcttgttccatggtaca

SEQ ID NO: 2643 - DNA, 20 bp, synthetic construct
  source 1..20: mol_type = other DNA
tctgatacatttctagaatg

SEQ ID NO: 2644 - DNA, 20 bp, synthetic construct
  source 1..20: mol_type = other DNA
actcacagtttacatctcaa

SEQ ID NO: 2645 - DNA, 20 bp, synthetic construct
  source 1..20: mol_type = other DNA
gtagaattaaaatatacacc

SEQ ID NO: 2646 - DNA, 20 bp, synthetic construct
  source 1..20: mol_type = other DNA
aggtcttgaattactttcac

SEQ ID NO: 2647 - DNA, 20 bp, synthetic construct
  source 1..20: mol_type = other DNA
ttggaccaaccctccttctg

SEQ ID NO: 2648 - DNA, 20 bp, synthetic construct
  source 1..20: mol_type = other DNA
tttgcaaacctccctctccc

SEQ ID NO: 2649 - DNA, 20 bp, synthetic construct
  source 1..20: mol_type = other DNA
gctcaggtagccgatgacag

SEQ ID NO: 2650 - DNA, 20 bp, synthetic construct
  source 1..20: mol_type = other DNA
tcagttcgccattctcagag

SEQ ID NO: 2651 - DNA, 20 bp, synthetic construct
  source 1..20: mol_type = other DNA
agctgggttcctgatgttga

SEQ ID NO: 2652 - DNA, 20 bp, synthetic construct
  source 1..20: mol_type = other DNA
caaaatctaattcctcatgt

SEQ ID NO: 2653 - DNA, 20 bp, synthetic construct
  source 1..20: mol_type = other DNA
tagttcataattcacattca

SEQ ID NO: 2654 - DNA, 20 bp, synthetic construct
  source 1..20: mol_type = other DNA
ctcagagtttctaagagccc

SEQ ID NO: 2655 - DNA, 20 bp, synthetic construct
  source 1..20: mol_type = other DNA
agttgcagccatccaagtaa

SEQ ID NO: 2656 - DNA, 20 bp, synthetic construct
  source 1..20: mol_type = other DNA
agcccgtattcctcttacca

SEQ ID NO: 2657 - DNA, 20 bp, synthetic construct
  source 1..20: mol_type = other DNA
gggaagatcaaccaaacaag

SEQ ID NO: 2658 - DNA, 20 bp, synthetic construct
  source 1..20: mol_type = other DNA
ggtttcttattaatagtatt

SEQ ID NO: 2659 - DNA, 20 bp, synthetic construct
  source 1..20: mol_type = other DNA
acaaccctactccagagcag

SEQ ID NO: 2660 - DNA, 20 bp, synthetic construct
  source 1..20: mol_type = other DNA
aacagtagccatgacaacca

SEQ ID NO: 2661 - DNA, 20 bp, synthetic construct
  source 1..20: mol_type = other DNA
tgccagaaacacaacactgt

SEQ ID NO: 2662 - DNA, 20 bp, synthetic construct
  source 1..20: mol_type = other DNA
catgtaactttcaacccttc

SEQ ID NO: 2663 - DNA, 20 bp, synthetic construct
  source 1..20: mol_type = other DNA
ttttgtccccataatgagtc

SEQ ID NO: 2664 - DNA, 20 bp, synthetic construct
  source 1..20: mol_type = other DNA
acatgaaaaactgaagccgg

SEQ ID NO: 2665 - DNA, 20 bp, synthetic construct
  source 1..20: mol_type = other DNA
cctgggccagaaaactgaaa

SEQ ID NO: 2666 - DNA, 20 bp, synthetic construct
  source 1..20: mol_type = other DNA
tttcttttcaataaggtgca

SEQ ID NO: 2667 - DNA, 20 bp, synthetic construct
  source 1..20: mol_type = other DNA
ctagaaaacctgcaagcacc

SEQ ID NO: 2668 - DNA, 20 bp, synthetic construct
  source 1..20: mol_type = other DNA
gctgaatttcaaacgcagca

SEQ ID NO: 2669 - DNA, 20 bp, synthetic construct
  source 1..20: mol_type = other DNA
gcagtaatttaaagtatgaa

SEQ ID NO: 2670 - DNA, 20 bp, synthetic construct
  source 1..20: mol_type = other DNA
aacaaattttaaagctcttt

SEQ ID NO: 2671 - DNA, 20 bp, synthetic construct
  source 1..20: mol_type = other DNA
agcatcaaccaaattcagta

SEQ ID NO: 2672 - DNA, 20 bp, synthetic construct
  source 1..20: mol_type = other DNA
ccctgacctatttaacatac

SEQ ID NO: 2673 - DNA, 20 bp, synthetic construct
  source 1..20: mol_type = other DNA
ctgtttaaccaaaaacatct

SEQ ID NO: 2674 - DNA, 20 bp, synthetic construct
  source 1..20: mol_type = other DNA
atcactaaacgatagcacaa

SEQ ID NO: 2675 - DNA, 20 bp, synthetic construct
  source 1..20: mol_type = other DNA
aactccttttaaattgaatt

SEQ ID NO: 2676 - DNA, 20 bp, synthetic construct
  source 1..20: mol_type = other DNA
gggattaaataattatgtgc

SEQ ID NO: 2677 - DNA, 20 bp, synthetic construct
  source 1..20: mol_type = other DNA
gctagcatattttaaagaag

SEQ ID NO: 2678 - DNA, 20 bp, synthetic construct
  source 1..20: mol_type = other DNA
ccagcatttcaaagagcaac

SEQ ID NO: 2679 - DNA, 20 bp, synthetic construct
  source 1..20: mol_type = other DNA
ggcatgtttatataacagcc

SEQ ID NO: 2680 - DNA, 20 bp, synthetic construct
  source 1..20: mol_type = other DNA
ttcctaaaagaatttatcca

SEQ ID NO: 2681 - DNA, 20 bp, synthetic construct
  source 1..20: mol_type = other DNA
gtttcaatattttatgcaaa

SEQ ID NO: 2682 - DNA, 20 bp, synthetic construct
  source 1..20: mol_type = other DNA
gcagtaataatttagccaaa

SEQ ID NO: 2683 - DNA, 20 bp, synthetic construct
  source 1..20: mol_type = other DNA
gctattagacaatatagagt

SEQ ID NO: 2684 - DNA, 20 bp, synthetic construct
  source 1..20: mol_type = other DNA
cacttcaaacctttatcagt

SEQ ID NO: 2685 - DNA, 20 bp, synthetic construct
  source 1..20: mol_type = other DNA
aatcctttaatttaacaacc

SEQ ID NO: 2686 - DNA, 20 bp, synthetic construct
  source 1..20: mol_type = other DNA
ccatgaagaatttaacctca

SEQ ID NO: 2687 - DNA, 20 bp, synthetic construct
  source 1..20: mol_type = other DNA
ggaggttaattcattacaca

SEQ ID NO: 2688 - DNA, 20 bp, synthetic construct
  source 1..20: mol_type = other DNA
tggccttatcatacctaaat

SEQ ID NO: 2689 - DNA, 20 bp, synthetic construct
  source 1..20: mol_type = other DNA
attgatcaccccagcaccag

SEQ ID NO: 2690 - DNA, 20 bp, synthetic construct
  source 1..20: mol_type = other DNA
ttaccccaagcccagcaggt

SEQ ID NO: 2691 - DNA, 20 bp, synthetic construct
  source 1..20: mol_type = other DNA
cccaaaacaattcaaaccat

SEQ ID NO: 2692 - DNA, 20 bp, synthetic construct
  source 1..20: mol_type = other DNA
attttctttctcctagtacc

SEQ ID NO: 2693 - DNA, 20 bp, synthetic construct
  source 1..20: mol_type = other DNA
agaggctgccaggcctggga

SEQ ID NO: 2694 - DNA, 20 bp, synthetic construct
  source 1..20: mol_type = other DNA
tggaacctcaattaagtcca

SEQ ID NO: 2695 - DNA, 20 bp, synthetic construct
  source 1..20: mol_type = other DNA
accaccatactatatcacac

SEQ ID NO: 2696 - DNA, 20 bp, synthetic construct
  source 1..20: mol_type = other DNA
ccctcagttttatatgccat

SEQ ID NO: 2697 - DNA, 20 bp, synthetic construct
  source 1..20: mol_type = other DNA
acttatggcctcaaacttgg

SEQ ID NO: 2698 - DNA, 20 bp, synthetic construct
  source 1..20: mol_type = other DNA
aagttcagccttctttctag

SEQ ID NO: 2699 - DNA, 20 bp, synthetic construct
  source 1..20: mol_type = other DNA
agcactttaccaatacattt

SEQ ID NO: 2700 - DNA, 20 bp, synthetic construct
  source 1..20: mol_type = other DNA
actatctattttttgataca

SEQ ID NO: 2701 - DNA, 20 bp, synthetic construct
  source 1..20: mol_type = other DNA
gtaaccaatctatcacacca

SEQ ID NO: 2702 - DNA, 20 bp, synthetic construct
  source 1..20: mol_type = other DNA
atcccacattaaaagctggg

SEQ ID NO: 2703 - DNA, 20 bp, synthetic construct
  source 1..20: mol_type = other DNA
gcattcttaactttgtctgc

SEQ ID NO: 2704 - DNA, 20 bp, synthetic construct
  source 1..20: mol_type = other DNA
gtgctatgtctatatacaca

SEQ ID NO: 2705 - DNA, 20 bp, synthetic construct
  source 1..20: mol_type = other DNA
gggctcataattatttttta

SEQ ID NO: 2706 - DNA, 20 bp, synthetic construct
  source 1..20: mol_type = other DNA
gaatagcctttataactttt

SEQ ID NO: 2707 - DNA, 20 bp, synthetic construct
  source 1..20: mol_type = other DNA
tcagttattttctctccact

SEQ ID NO: 2708 - DNA, 20 bp, synthetic construct
  source 1..20: mol_type = other DNA
cctgccaaaaaatcttcttc

SEQ ID NO: 2709 - DNA, 20 bp, synthetic construct
  source 1..20: mol_type = other DNA
ttgctggttctttaacccct

SEQ ID NO: 2710 - DNA, 20 bp, synthetic construct
  source 1..20: mol_type = other DNA
cggctgttcaatcaagcacc

SEQ ID NO: 2711 - DNA, 20 bp, synthetic construct
  source 1..20: mol_type = other DNA
cctcaaaatattattgaggg

SEQ ID NO: 2712 - DNA, 20 bp, synthetic construct
  source 1..20: mol_type = other DNA
tgaagaaatctcactgaggg

SEQ ID NO: 2713 - DNA, 20 bp, synthetic construct
  source 1..20: mol_type = other DNA
agattattcagataatctga

SEQ ID NO: 2714 - DNA, 20 bp, synthetic construct
  source 1..20: mol_type = other DNA
ccttagaattaaatgctgtg

SEQ ID NO: 2715 - DNA, 20 bp, synthetic construct
  source 1..20: mol_type = other DNA
tcctcgatactaaccccttc

SEQ ID NO: 2716 - DNA, 20 bp, synthetic construct
  source 1..20: mol_type = other DNA
tcaaaactccaaagacacca

SEQ ID NO: 2717 - DNA, 20 bp, synthetic construct
  source 1..20: mol_type = other DNA
gagccacattatacacactt

SEQ ID NO: 2718 - DNA, 20 bp, synthetic construct
  source 1..20: mol_type = other DNA
cctcttagagtcattaacaa

SEQ ID NO: 2719 - DNA, 20 bp, synthetic construct
  source 1..20: mol_type = other DNA
agtaggatccaaaggcatga

SEQ ID NO: 2720 - DNA, 20 bp, synthetic construct
  source 1..20: mol_type = other DNA
gttctgatacatttctagaa

SEQ ID NO: 2721 - DNA, 20 bp, synthetic construct
  source 1..20: mol_type = other DNA
gaactcacagtttacatctc

SEQ ID NO: 2722 - DNA, 20 bp, synthetic construct
  source 1..20: mol_type = other DNA
tgtagaattaaaatatacac

SEQ ID NO: 2723 - DNA, 20 bp, synthetic construct
  source 1..20: mol_type = other DNA
tgagtccctaaaactggatt

SEQ ID NO: 2724 - DNA, 20 bp, synthetic construct
  source 1..20: mol_type = other DNA
tcctttctagatgtagtaga

SEQ ID NO: 2725 - DNA, 20 bp, synthetic construct
  source 1..20: mol_type = other DNA
gtttgcaaacctccctctcc

SEQ ID NO: 2726 - DNA, 20 bp, synthetic construct
  source 1..20: mol_type = other DNA
ggagcctttcatgaagtagg

SEQ ID NO: 2727 - DNA, 20 bp, synthetic construct
  source 1..20: mol_type = other DNA
tctggaaacttcagttcgcc

SEQ ID NO: 2728 - DNA, 20 bp, synthetic construct
  source 1..20: mol_type = other DNA
ttaactttccaaatctgcca

SEQ ID NO: 2729 - DNA, 20 bp, synthetic construct
  source 1..20: mol_type = other DNA
cttcaaaatctaattcctca

SEQ ID NO: 2730 - DNA, 20 bp, synthetic construct
  source 1..20: mol_type = other DNA
tactagttcataattcacat

SEQ ID NO: 2731 - DNA, 20 bp, synthetic construct
  source 1..20: mol_type = other DNA
tctcagagtttctaagagcc

SEQ ID NO: 2732 - DNA, 20 bp, synthetic construct
  source 1..20: mol_type = other DNA
atttgttcagtttagttgca

SEQ ID NO: 2733 - DNA, 20 bp, synthetic construct
  source 1..20: mol_type = other DNA
gagaacaaagtctatgtggc

SEQ ID NO: 2734 - DNA, 20 bp, synthetic construct
  source 1..20: mol_type = other DNA
ggctccttccctccagccct

SEQ ID NO: 2735 - DNA, 20 bp, synthetic construct
  source 1..20: mol_type = other DNA
ttggtttcttattaatagta

SEQ ID NO: 2736 - DNA, 20 bp, synthetic construct
  source 1..20: mol_type = other DNA
ttgtacaaccctactccaga

SEQ ID NO: 2737 - DNA, 20 bp, synthetic construct
  source 1..20: mol_type = other DNA
ggttcatgaaacagtagcca

SEQ ID NO: 2738 - DNA, 20 bp, synthetic construct
  source 1..20: mol_type = other DNA
tatgccagaaacacaacact

SEQ ID NO: 2739 - DNA, 20 bp, synthetic construct
  source 1..20: mol_type = other DNA
acatgtaactttcaaccctt

SEQ ID NO: 2740 - DNA, 20 bp, synthetic construct
  source 1..20: mol_type = other DNA
tttttgtccccataatgagt

SEQ ID NO: 2741 - DNA, 20 bp, synthetic construct
  source 1..20: mol_type = other DNA
gggacatgaaaaactgaagc

SEQ ID NO: 2742 - DNA, 20 bp, synthetic construct
  source 1..20: mol_type = other DNA
aggatttaccccactcctgg

SEQ ID NO: 2743 - DNA, 20 bp, synthetic construct
  source 1..20: mol_type = other DNA
attttcttttcaataaggtg

SEQ ID NO: 2744 - DNA, 20 bp, synthetic construct
  source 1..20: mol_type = other DNA
tctacctagaaaacctgcaa

SEQ ID NO: 2745 - DNA, 20 bp, synthetic construct
  source 1..20: mol_type = other DNA
ctcacattttaaagagtctg

SEQ ID NO: 2746 - DNA, 20 bp, synthetic construct
  source 1..20: mol_type = other DNA
tcactgaacccttatttttt

SEQ ID NO: 2747 - DNA, 20 bp, synthetic construct
  source 1..20: mol_type = other DNA
actagaaaagccacccttct

SEQ ID NO: 2748 - DNA, 20 bp, synthetic construct
  source 1..20: mol_type = other DNA
agtctgtatatttatattta

SEQ ID NO: 2749 - DNA, 20 bp, synthetic construct
  source 1..20: mol_type = other DNA
cctttgttttaaaataggta

SEQ ID NO: 2750 - DNA, 20 bp, synthetic construct
  source 1..20: mol_type = other DNA
aatgccaaagatatacgcca

SEQ ID NO: 2751 - DNA, 20 bp, synthetic construct
  source 1..20: mol_type = other DNA
agttaatatccttaatacaa

SEQ ID NO: 2752 - DNA, 20 bp, synthetic construct
  source 1..20: mol_type = other DNA
aagtactatcattattgcat

SEQ ID NO: 2753 - DNA, 20 bp, synthetic construct
  source 1..20: mol_type = other DNA
ttccccttattttattcata

SEQ ID NO: 2754 - DNA, 20 bp, synthetic construct
  source 1..20: mol_type = other DNA
ttccttctagattaaagact

SEQ ID NO: 2755 - DNA, 20 bp, synthetic construct
  source 1..20: mol_type = other DNA
aacacaatttaaattgagtt

SEQ ID NO: 2756 - DNA, 20 bp, synthetic construct
  source 1..20: mol_type = other DNA
cctaagtacccttaattttt

SEQ ID NO: 2757 - DNA, 20 bp, synthetic construct
  source 1..20: mol_type = other DNA
tgtctatttcaaagaagcga

SEQ ID NO: 2758 - DNA, 20 bp, synthetic construct
  source 1..20: mol_type = other DNA
cacacaattcaaaacttgaa

SEQ ID NO: 2759 - DNA, 20 bp, synthetic construct
  source 1..20: mol_type = other DNA
agcagaatctaaatcgaaca

SEQ ID NO: 2760 - DNA, 20 bp, synthetic construct
  source 1..20: mol_type = other DNA
cgtgtttttatttaacaata

SEQ ID NO: 2761 - DNA, 20 bp, synthetic construct
  source 1..20: mol_type = other DNA
atttcttatatttatgggct

SEQ ID NO: 2762 - DNA, 20 bp, synthetic construct
  source 1..20: mol_type = other DNA
tatagtagtatttatagctc

SEQ ID NO: 2763 - DNA, 20 bp, synthetic construct
  source 1..20: mol_type = other DNA
accccatttcaaagacaagg

SEQ ID NO: 2764 - DNA, 20 bp, synthetic construct
  source 1..20: mol_type = other DNA
tggaggttaattcattacac

SEQ ID NO: 2765 - DNA, 20 bp, synthetic construct
  source 1..20: mol_type = other DNA
ttggccttatcatacctaaa

SEQ ID NO: 2766 - DNA, 20 bp, synthetic construct
  source 1..20: mol_type = other DNA
gtgcccagcccttccacctg

SEQ ID NO: 2767 - DNA, 20 bp, synthetic construct
  source 1..20: mol_type = other DNA
gactttaccccaagcccagc

SEQ ID NO: 2768 - DNA, 20 bp, synthetic construct
  source 1..20: mol_type = other DNA
tgcccaaaacaattcaaacc

SEQ ID NO: 2769 - DNA, 20 bp, synthetic construct
  source 1..20: mol_type = other DNA
agttcattttctttctccta

SEQ ID NO: 2770 - DNA, 20 bp, synthetic construct
  source 1..20: mol_type = other DNA
gtctggtttctgcagaggct

SEQ ID NO: 2771 - DNA, 20 bp, synthetic construct
  source 1..20: mol_type = other DNA
cctttggaacctcaattaag

SEQ ID NO: 2772 - DNA, 20 bp, synthetic construct
  source 1..20: mol_type = other DNA
tgtcaccaccatactatatc

SEQ ID NO: 2773 - DNA, 20 bp, synthetic construct
  source 1..20: mol_type = other DNA
cccctcagttttatatgcca

SEQ ID NO: 2774 - DNA, 20 bp, synthetic construct
  source 1..20: mol_type = other DNA
gcgccacagacttatggcct

SEQ ID NO: 2775 - DNA, 20 bp, synthetic construct
  source 1..20: mol_type = other DNA
ggcagggtaaaaatggctta

SEQ ID NO: 2776 - DNA, 20 bp, synthetic construct
  source 1..20: mol_type = other DNA
gagcactttaccaatacatt

SEQ ID NO: 2777 - DNA, 20 bp, synthetic construct
  source 1..20: mol_type = other DNA
accaactatctattttttga

SEQ ID NO: 2778 - DNA, 20 bp, synthetic construct
  source 1..20: mol_type = other DNA
tgtaaccaatctatcacacc

SEQ ID NO: 2779 - DNA, 20 bp, synthetic construct
  source 1..20: mol_type = other DNA
acacaaatcccacattaaaa

SEQ ID NO: 2780 - DNA, 20 bp, synthetic construct
  source 1..20: mol_type = other DNA
tgggcattcttaactttgtc

SEQ ID NO: 2781 - DNA, 20 bp, synthetic construct
  source 1..20: mol_type = other DNA
ttgtatatttcaatcttaga

SEQ ID NO: 2782 - DNA, 20 bp, synthetic construct
  source 1..20: mol_type = other DNA
ttctgggctcataattattt

SEQ ID NO: 2783 - DNA, 20 bp, synthetic construct
  source 1..20: mol_type = other DNA
tagaatagcctttataactt

SEQ ID NO: 2784 - DNA, 20 bp, synthetic construct
  source 1..20: mol_type = other DNA
ttcagttattttctctccac

SEQ ID NO: 2785 - DNA, 20 bp, synthetic construct
  source 1..20: mol_type = other DNA
tcctgccaaaaaatcttctt

SEQ ID NO: 2786 - DNA, 20 bp, synthetic construct
  source 1..20: mol_type = other DNA
actccctacactgtagcaac

SEQ ID NO: 2787 - DNA, 20 bp, synthetic construct
  source 1..20: mol_type = other DNA
aatggtatcccattcttccg

SEQ ID NO: 2788 - DNA, 20 bp, synthetic construct
  source 1..20: mol_type = other DNA
ggcctcaaaatattattgag

SEQ ID NO: 2789 - DNA, 20 bp, synthetic construct
  source 1..20: mol_type = other DNA
ttaactgatcattaaccgtt

SEQ ID NO: 2790 - DNA, 20 bp, synthetic construct
  source 1..20: mol_type = other DNA
aagattattcagataatctg

SEQ ID NO: 2791 - DNA, 20 bp, synthetic construct
  source 1..20: mol_type = other DNA
ggccttagaattaaatgctg

SEQ ID NO: 2792 - DNA, 20 bp, synthetic construct
  source 1..20: mol_type = other DNA
ctcctcgatactaacccctt

SEQ ID NO: 2793 - DNA, 20 bp, synthetic construct
  source 1..20: mol_type = other DNA
tctcaaaactccaaagacac

SEQ ID NO: 2794 - DNA, 20 bp, synthetic construct
  source 1..20: mol_type = other DNA
gtgagccacattatacacac

SEQ ID NO: 2795 - DNA, 20 bp, synthetic construct
  source 1..20: mol_type = other DNA
tcttgcaaacctcttagagt

SEQ ID NO: 2796 - DNA, 20 bp, synthetic construct
  source 1..20: mol_type = other DNA
attgactgaaataagtagga

SEQ ID NO: 2797 - DNA, 20 bp, synthetic construct
  source 1..20: mol_type = other DNA
tagttctgatacatttctag

SEQ ID NO: 2798 - DNA, 20 bp, synthetic construct
  source 1..20: mol_type = other DNA
catattatctccaaataagc

SEQ ID NO: 2799 - DNA, 20 bp, synthetic construct
  source 1..20: mol_type = other DNA
ggtctatgagaattgtagaa

SEQ ID NO: 2800 - DNA, 20 bp, synthetic construct
  source 1..20: mol_type = other DNA
ctgagtccctaaaactggat

SEQ ID NO: 2801 - DNA, 20 bp, synthetic construct
  source 1..20: mol_type = other DNA
agtcaatttccaatgtcctt

SEQ ID NO: 2802 - DNA, 20 bp, synthetic construct
  source 1..20: mol_type = other DNA
agtttgcaaacctccctctc

SEQ ID NO: 2803 - DNA, 20 bp, synthetic construct
  source 1..20: mol_type = other DNA
tggagcctttcatgaagtag

SEQ ID NO: 2804 - DNA, 20 bp, synthetic construct
  source 1..20: mol_type = other DNA
ctctggaaacttcagttcgc

SEQ ID NO: 2805 - DNA, 20 bp, synthetic construct
  source 1..20: mol_type = other DNA
gttaactttccaaatctgcc

SEQ ID NO: 2806 - DNA, 20 bp, synthetic construct
  source 1..20: mol_type = other DNA
atcttcaaaatctaattcct

SEQ ID NO: 2807 - DNA, 20 bp, synthetic construct
  source 1..20: mol_type = other DNA
atactagttcataattcaca

SEQ ID NO: 2808 - DNA, 20 bp, synthetic construct
  source 1..20: mol_type = other DNA
aagaaaattctcagagtttc

SEQ ID NO: 2809 - DNA, 20 bp, synthetic construct
  source 1..20: mol_type = other DNA
agtcaggtatttgttcagtt

SEQ ID NO: 2810 - DNA, 20 bp, synthetic construct
  source 1..20: mol_type = other DNA
gtaaatagtgatattaatga

SEQ ID NO: 2811 - DNA, 20 bp, synthetic construct
  source 1..20: mol_type = other DNA
gctccccgccccagcactca

SEQ ID NO: 2812 - DNA, 20 bp, synthetic construct
  source 1..20: mol_type = other DNA
ttgttggtttcttattaata

SEQ ID NO: 2813 - DNA, 20 bp, synthetic construct
  source 1..20: mol_type = other DNA
attgtacaaccctactccag

SEQ ID NO: 2814 - DNA, 20 bp, synthetic construct
  source 1..20: mol_type = other DNA
gtggttcatgaaacagtagc

SEQ ID NO: 2815 - DNA, 20 bp, synthetic construct
  source 1..20: mol_type = other DNA
cctatgccagaaacacaaca

SEQ ID NO: 2816 - DNA, 20 bp, synthetic construct
  source 1..20: mol_type = other DNA
ctatatacaaaaaaacatgt

SEQ ID NO: 2817 - DNA, 20 bp, synthetic construct
  source 1..20: mol_type = other DNA
cccccatttaaatgaggtgt

SEQ ID NO: 2818 - DNA, 20 bp, synthetic construct
  source 1..20: mol_type = other DNA
cagttgaaccatttgtatgc

SEQ ID NO: 2819 - DNA, 20 bp, synthetic construct
  source 1..20: mol_type = other DNA
tgcactaactaaaggattta

SEQ ID NO: 2820 - DNA, 20 bp, synthetic construct
  source 1..20: mol_type = other DNA
aattttcttttcaataaggt

SEQ ID NO: 2821 - DNA, 20 bp, synthetic construct
  source 1..20: mol_type = other DNA
ttctacctagaaaacctgca

SEQ ID NO: 2822 - DNA, 20 bp, synthetic construct
  source 1..20: mol_type = other DNA
ctcgaaaaacatatccccca

SEQ ID NO: 2823 - DNA, 20 bp, synthetic construct
  source 1..20: mol_type = other DNA
tggtaattttaaaatatggg

SEQ ID NO: 2824 - DNA, 20 bp, synthetic construct
  source 1..20: mol_type = other DNA
gtgttaattcaaaaaatttc

SEQ ID NO: 2825 - DNA, 20 bp, synthetic construct
  source 1..20: mol_type = other DNA
tgcatacaaatttagtctgt

SEQ ID NO: 2826 - DNA, 20 bp, synthetic construct
  source 1..20: mol_type = other DNA
tctagattacaaaccatcct

SEQ ID NO: 2827 - DNA, 20 bp, synthetic construct
  source 1..20: mol_type = other DNA
tttcattttatttaagccaa

SEQ ID NO: 2828 - DNA, 20 bp, synthetic construct
  source 1..20: mol_type = other DNA
aagatgttttaaaatctgac

SEQ ID NO: 2829 - DNA, 20 bp, synthetic construct
  source 1..20: mol_type = other DNA
gtacttgttccttaaccaag

SEQ ID NO: 2830 - DNA, 20 bp, synthetic construct
  source 1..20: mol_type = other DNA
tcagtttacctttaatggaa

SEQ ID NO: 2831 - DNA, 20 bp, synthetic construct
  source 1..20: mol_type = other DNA
tgctcaatattttaaacatt

SEQ ID NO: 2832 - DNA, 20 bp, synthetic construct
  source 1..20: mol_type = other DNA
gtcggataaatttatccaca

SEQ ID NO: 2833 - DNA, 20 bp, synthetic construct
  source 1..20: mol_type = other DNA
ttagcaaacatttatgagca

SEQ ID NO: 2834 - DNA, 20 bp, synthetic construct
  source 1..20: mol_type = other DNA
cttccaatccattacatctt

SEQ ID NO: 2835 - DNA, 20 bp, synthetic construct
  source 1..20: mol_type = other DNA
ccttccaacccttagccttt

SEQ ID NO: 2836 - DNA, 20 bp, synthetic construct
  source 1..20: mol_type = other DNA
agccaaaaacccatggacca

SEQ ID NO: 2837 - DNA, 20 bp, synthetic construct
  source 1..20: mol_type = other DNA
acagtaatcttttatacaag

SEQ ID NO: 2838 - DNA, 20 bp, synthetic construct
  source 1..20: mol_type = other DNA
ttcccgaacccttaaggata

SEQ ID NO: 2839 - DNA, 20 bp, synthetic construct
  source 1..20: mol_type = other DNA
agttgacacctttatagtag

SEQ ID NO: 2840 - DNA, 20 bp, synthetic construct
  source 1..20: mol_type = other DNA
gtcttaaaactattcactgt

SEQ ID NO: 2841 - DNA, 20 bp, synthetic construct
  source 1..20: mol_type = other DNA
ataactagccccactctcca

SEQ ID NO: 2842 - DNA, 20 bp, synthetic construct
  source 1..20: mol_type = other DNA
gttggccttatcatacctaa

SEQ ID NO: 2843 - DNA, 20 bp, synthetic construct
  source 1..20: mol_type = other DNA
gctgccttccatctgttttt

SEQ ID NO: 2844 - DNA, 20 bp, synthetic construct
  source 1..20: mol_type = other DNA
tgactttaccccaagcccag

SEQ ID NO: 2845 - DNA, 20 bp, synthetic construct
  source 1..20: mol_type = other DNA
gagacaagaaacactgtctc

SEQ ID NO: 2846 - DNA, 20 bp, synthetic construct
  source 1..20: mol_type = other DNA
ctcaaggtagttcattttct

SEQ ID NO: 2847 - DNA, 20 bp, synthetic construct
  source 1..20: mol_type = other DNA
gcctacaatcccagctttag

SEQ ID NO: 2848 - DNA, 20 bp, synthetic construct
  source 1..20: mol_type = other DNA
gagaaaacccctcaggaagg

SEQ ID NO: 2849 - DNA, 20 bp, synthetic construct
  source 1..20: mol_type = other DNA
tctgtcaccaccatactata

SEQ ID NO: 2850 - DNA, 20 bp, synthetic construct
  source 1..20: mol_type = other DNA
ctaaacacccctcagtttta

SEQ ID NO: 2851 - DNA, 20 bp, synthetic construct
  source 1..20: mol_type = other DNA
tggatgcgccacagacttat

SEQ ID NO: 2852 - DNA, 20 bp, synthetic construct
  source 1..20: mol_type = other DNA
aggcagggtaaaaatggctt

SEQ ID NO: 2853 - DNA, 20 bp, synthetic construct
  source 1..20: mol_type = other DNA
ccagagcactttaccaatac

SEQ ID NO: 2854 - DNA, 20 bp, synthetic construct
  source 1..20: mol_type = other DNA
caccaactatctattttttg

SEQ ID NO: 2855 - DNA, 20 bp, synthetic construct
  source 1..20: mol_type = other DNA
cagttgtaaccaatctatca

SEQ ID NO: 2856 - DNA, 20 bp, synthetic construct
  source 1..20: mol_type = other DNA
ctcctaacacaaatcccaca

SEQ ID NO: 2857 - DNA, 20 bp, synthetic construct
  source 1..20: mol_type = other DNA
cgaaattattaaattgggca

SEQ ID NO: 2858 - DNA, 20 bp, synthetic construct
  source 1..20: mol_type = other DNA
gattgtatatttcaatctta

SEQ ID NO: 2859 - DNA, 20 bp, synthetic construct
  source 1..20: mol_type = other DNA
acaacaccgactcacttctg

SEQ ID NO: 2860 - DNA, 20 bp, synthetic construct
  source 1..20: mol_type = other DNA
tcaaacaccctaagcagtaa

SEQ ID NO: 2861 - DNA, 20 bp, synthetic construct
  source 1..20: mol_type = other DNA
cttcagttattttctctcca

SEQ ID NO: 2862 - DNA, 20 bp, synthetic construct
  source 1..20: mol_type = other DNA
atcctgccaaaaaatcttct

SEQ ID NO: 2863 - DNA, 20 bp, synthetic construct
  source 1..20: mol_type = other DNA
ccttactccctacactgtag

SEQ ID NO: 2864 - DNA, 20 bp, synthetic construct
  source 1..20: mol_type = other DNA
atgttcttccccatctccat

SEQ ID NO: 2865 - DNA, 20 bp, synthetic construct
  source 1..20: mol_type = other DNA
cggcctcaaaatattattga

SEQ ID NO: 2866 - DNA, 20 bp, synthetic construct
  source 1..20: mol_type = other DNA
gatataaacattcttaaagg

SEQ ID NO: 2867 - DNA, 20 bp, synthetic construct
  source 1..20: mol_type = other DNA
ggaagattattcagataatc

SEQ ID NO: 2868 - DNA, 20 bp, synthetic construct
  source 1..20: mol_type = other DNA
aggccttagaattaaatgct

SEQ ID NO: 2869 - DNA, 20 bp, synthetic construct
  source 1..20: mol_type = other DNA
cagtctcctcgatactaacc

SEQ ID NO: 2870 - DNA, 20 bp, synthetic construct
  source 1..20: mol_type = other DNA
atctcaaaactccaaagaca

SEQ ID NO: 2871 - DNA, 20 bp, synthetic construct
  source 1..20: mol_type = other DNA
tgtgagccacattatacaca

SEQ ID NO: 2872 - DNA, 20 bp, synthetic construct
  source 1..20: mol_type = other DNA
ctcttgcaaacctcttagag

SEQ ID NO: 2873 - DNA, 20 bp, synthetic construct
  source 1..20: mol_type = other DNA
tcctgctaccccccaacagt

SEQ ID NO: 2874 - DNA, 20 bp, synthetic construct
  source 1..20: mol_type = other DNA
ttcatcttctttgtttcctt

SEQ ID NO: 2875 - DNA, 20 bp, synthetic construct
  source 1..20: mol_type = other DNA
aacaaaatacatattatctc

SEQ ID NO: 2876 - DNA, 20 bp, synthetic construct
  source 1..20: mol_type = other DNA
ccgtttctacagaaatttaa

SEQ ID NO: 2877 - DNA, 20 bp, synthetic construct
  source 1..20: mol_type = other DNA
tctgagtccctaaaactgga

SEQ ID NO: 2878 - DNA, 20 bp, synthetic construct
  source 1..20: mol_type = other DNA
cccagcccctaaaaggatgc

SEQ ID NO: 2879 - DNA, 20 bp, synthetic construct
  source 1..20: mol_type = other DNA
aggtatgaactcacacagac

SEQ ID NO: 2880 - DNA, 20 bp, synthetic construct
  source 1..20: mol_type = other DNA
ttccaccttctttagctccc

SEQ ID NO: 2881 - DNA, 20 bp, synthetic construct
  source 1..20: mol_type = other DNA
caggcaatcccattttctct

SEQ ID NO: 2882 - DNA, 20 bp, synthetic construct
  source 1..20: mol_type = other DNA
atgttcttttaaatggttaa

SEQ ID NO: 2883 - DNA, 20 bp, synthetic construct
  source 1..20: mol_type = other DNA
catcttcaaaatctaattcc

SEQ ID NO: 2884 - DNA, 20 bp, synthetic construct
  source 1..20: mol_type = other DNA
cacatactagttcataattc

SEQ ID NO: 2885 - DNA, 20 bp, synthetic construct
  source 1..20: mol_type = other DNA
tctctcaatgaatctgaaga

SEQ ID NO: 2886 - DNA, 20 bp, synthetic construct
  source 1..20: mol_type = other DNA
gggtaaaagaaaagtcaggt

SEQ ID NO: 2887 - DNA, 20 bp, synthetic construct
  source 1..20: mol_type = other DNA
ttgtaaatagtgatattaat

SEQ ID NO: 2888 - DNA, 20 bp, synthetic construct
  source 1..20: mol_type = other DNA
ctgcggttcctcccccgggt

SEQ ID NO: 2889 - DNA, 20 bp, synthetic construct
  source 1..20: mol_type = other DNA
atatatttagaaatccctag

SEQ ID NO: 2890 - DNA, 20 bp, synthetic construct
  source 1..20: mol_type = other DNA
aattgtacaaccctactcca

SEQ ID NO: 2891 - DNA, 20 bp, synthetic construct
  source 1..20: mol_type = other DNA
gcaacagaccagtctgttga

SEQ ID NO: 2892 - DNA, 20 bp, synthetic construct
  source 1..20: mol_type = other DNA
tccctatgccagaaacacaa

SEQ ID NO: 2893 - DNA, 20 bp, synthetic construct
  source 1..20: mol_type = other DNA
tctatatacaaaaaaacatg

SEQ ID NO: 2894 - DNA, 20 bp, synthetic construct
  source 1..20: mol_type = other DNA
ccccccatttaaatgaggtg

SEQ ID NO: 2895 - DNA, 20 bp, synthetic construct
  source 1..20: mol_type = other DNA
tacagttgaaccatttgtat

SEQ ID NO: 2896 - DNA, 20 bp, synthetic construct
  source 1..20: mol_type = other DNA
gcacaggtatcaagttcaaa

SEQ ID NO: 2897 - DNA, 20 bp, synthetic construct
  source 1..20: mol_type = other DNA
acttaaaattttcttttcaa

SEQ ID NO: 2898 - DNA, 20 bp, synthetic construct
  source 1..20: mol_type = other DNA
aatgaaataatttctaccta

SEQ ID NO: 2899 - DNA, 20 bp, synthetic construct
  source 1..20: mol_type = other DNA
ggcacattttaaaaagaagc

SEQ ID NO: 2900 - DNA, 20 bp, synthetic construct
  source 1..20: mol_type = other DNA
tgtttgctattttaagagcc

SEQ ID NO: 2901 - DNA, 20 bp, synthetic construct
  source 1..20: mol_type = other DNA
gctagtaaaatttagggcag

SEQ ID NO: 2902 - DNA, 20 bp, synthetic construct
  source 1..20: mol_type = other DNA
tctgaaaaacctcttcctct

SEQ ID NO: 2903 - DNA, 20 bp, synthetic construct
  source 1..20: mol_type = other DNA
gatgcatttcattactgctt

SEQ ID NO: 2904 - DNA, 20 bp, synthetic construct
  source 1..20: mol_type = other DNA
atgtaatattaaatagcatc

SEQ ID NO: 2905 - DNA, 20 bp, synthetic construct
  source 1..20: mol_type = other DNA
aggtaatttcaaagcttcca

SEQ ID NO: 2906 - DNA, 20 bp, synthetic construct
  source 1..20: mol_type = other DNA
ctttcaattccttaaaagga

SEQ ID NO: 2907 - DNA, 20 bp, synthetic construct
  source 1..20: mol_type = other DNA
acacacaaagaatgaaccat

SEQ ID NO: 2908 - DNA, 20 bp, synthetic construct
  source 1..20: mol_type = other DNA
atcctaattcaaaaactagt

SEQ ID NO: 2909 - DNA, 20 bp, synthetic construct
  source 1..20: mol_type = other DNA
agccataaaaccatgcggtt

SEQ ID NO: 2910 - DNA, 20 bp, synthetic construct
  source 1..20: mol_type = other DNA
ttacccaaattatcactgta

SEQ ID NO: 2911 - DNA, 20 bp, synthetic construct
  source 1..20: mol_type = other DNA
ggacttaacccttactccaa

SEQ ID NO: 2912 - DNA, 20 bp, synthetic construct
  source 1..20: mol_type = other DNA
tgttagctattttatatgga

SEQ ID NO: 2913 - DNA, 20 bp, synthetic construct
  source 1..20: mol_type = other DNA
ttacacagccaaaaacccat

SEQ ID NO: 2914 - DNA, 20 bp, synthetic construct
  source 1..20: mol_type = other DNA
tgagtaatttaaaatgccca

SEQ ID NO: 2915 - DNA, 20 bp, synthetic construct
  source 1..20: mol_type = other DNA
aaggtctgcctttaacattt

SEQ ID NO: 2916 - DNA, 20 bp, synthetic construct
  source 1..20: mol_type = other DNA
gtaaaatttctttatgtgtg

SEQ ID NO: 2917 - DNA, 20 bp, synthetic construct
  source 1..20: mol_type = other DNA
agtcttaaaactattcactg

SEQ ID NO: 2918 - DNA, 20 bp, synthetic construct
  source 1..20: mol_type = other DNA
tcaaggactccataactagc

SEQ ID NO: 2919 - DNA, 20 bp, synthetic construct
  source 1..20: mol_type = other DNA
gctgatctatctgttggcct

SEQ ID NO: 2920 - DNA, 20 bp, synthetic construct
  source 1..20: mol_type = other DNA
tagggctgccttccatctgt

SEQ ID NO: 2921 - DNA, 20 bp, synthetic construct
  source 1..20: mol_type = other DNA
gctgactttaccccaagccc

SEQ ID NO: 2922 - DNA, 20 bp, synthetic construct
  source 1..20: mol_type = other DNA
aatgctcaaaaaagccagac

SEQ ID NO: 2923 - DNA, 20 bp, synthetic construct
  source 1..20: mol_type = other DNA
ctgtgaagagtcaactttgc

SEQ ID NO: 2924 - DNA, 20 bp, synthetic construct
  source 1..20: mol_type = other DNA
cgcctacaatcccagcttta

SEQ ID NO: 2925 - DNA, 20 bp, synthetic construct
  source 1..20: mol_type = other DNA
ggaagattcttcaggctagg

SEQ ID NO: 2926 - DNA, 20 bp, synthetic construct
  source 1..20: mol_type = other DNA
gtctgtcaccaccatactat

SEQ ID NO: 2927 - DNA, 20 bp, synthetic construct
  source 1..20: mol_type = other DNA
cccaaactaaacacccctca

SEQ ID NO: 2928 - DNA, 20 bp, synthetic construct
  source 1..20: mol_type = other DNA
agccccatccttcttttgag

SEQ ID NO: 2929 - DNA, 20 bp, synthetic construct
  source 1..20: mol_type = other DNA
cgaggattacaggcagggta

SEQ ID NO: 2930 - DNA, 20 bp, synthetic construct
  source 1..20: mol_type = other DNA
cgtgtcaacccagagcactt

SEQ ID NO: 2931 - DNA, 20 bp, synthetic construct
  source 1..20: mol_type = other DNA
agtcaccaactatctatttt

SEQ ID NO: 2932 - DNA, 20 bp, synthetic construct
  source 1..20: mol_type = other DNA
tcagttgtaaccaatctatc

SEQ ID NO: 2933 - DNA, 20 bp, synthetic construct
  source 1..20: mol_type = other DNA
gcctcctaacacaaatccca

SEQ ID NO: 2934 - DNA, 20 bp, synthetic construct
  source 1..20: mol_type = other DNA
gcgaaattattaaattgggc

SEQ ID NO: 2935 - DNA, 20 bp, synthetic construct
  source 1..20: mol_type = other DNA
tgattgtatatttcaatctt

SEQ ID NO: 2936 - DNA, 20 bp, synthetic construct
  source 1..20: mol_type = other DNA
ggagacaacaccgactcact

SEQ ID NO: 2937 - DNA, 20 bp, synthetic construct
  source 1..20: mol_type = other DNA
tttcaaacaccctaagcagt

SEQ ID NO: 2938 - DNA, 20 bp, synthetic construct
  source 1..20: mol_type = other DNA
gaatcacacttcagttattt

SEQ ID NO: 2939 - DNA, 20 bp, synthetic construct
  source 1..20: mol_type = other DNA
ccatcctgccaaaaaatctt

SEQ ID NO: 2940 - DNA, 20 bp, synthetic construct
  source 1..20: mol_type = other DNA
ccccttactccctacactgt

SEQ ID NO: 2941 - DNA, 20 bp, synthetic construct
  source 1..20: mol_type = other DNA
cccatgttcttccccatctc

SEQ ID NO: 2942 - DNA, 20 bp, synthetic construct
  source 1..20: mol_type = other DNA
ccggcctcaaaatattattg

SEQ ID NO: 2943 - DNA, 20 bp, synthetic construct
  source 1..20: mol_type = other DNA
aaggatataaacattcttaa

SEQ ID NO: 2944 - DNA, 20 bp, synthetic construct
  source 1..20: mol_type = other DNA
agcggaagattattcagata

SEQ ID NO: 2945 - DNA, 20 bp, synthetic construct
  source 1..20: mol_type = other DNA
ccaaatctccaaagacaggc

SEQ ID NO: 2946 - DNA, 20 bp, synthetic construct
  source 1..20: mol_type = other DNA
actggtgcccaaatgtctat

SEQ ID NO: 2947 - DNA, 20 bp, synthetic construct
  source 1..20: mol_type = other DNA
gcatctcaaaactccaaaga

SEQ ID NO: 2948 - DNA, 20 bp, synthetic construct
  source 1..20: mol_type = other DNA
tgtgtgagccacattataca

SEQ ID NO: 2949 - DNA, 20 bp, synthetic construct
  source 1..20: mol_type = other DNA
ctccatagatcctcttgcaa

SEQ ID NO: 2950 - DNA, 20 bp, synthetic construct
  source 1..20: mol_type = other DNA
aagagatgaactaagcattc

SEQ ID NO: 2951 - DNA, 20 bp, synthetic construct
  source 1..20: mol_type = other DNA
gttgcttttctacttcatct

SEQ ID NO: 2952 - DNA, 20 bp, synthetic construct
  source 1..20: mol_type = other DNA
tctagaacaaaatacatatt

SEQ ID NO: 2953 - DNA, 20 bp, synthetic construct
  source 1..20: mol_type = other DNA
atccatgaagccaggcatgg

SEQ ID NO: 2954 - DNA, 20 bp, synthetic construct
  source 1..20: mol_type = other DNA
catctgagtccctaaaactg

SEQ ID NO: 2955 - DNA, 20 bp, synthetic construct
  source 1..20: mol_type = other DNA
gtccccagcccctaaaagga

SEQ ID NO: 2956 - DNA, 20 bp, synthetic construct
  source 1..20: mol_type = other DNA
caggtatgaactcacacaga

SEQ ID NO: 2957 - DNA, 20 bp, synthetic construct
  source 1..20: mol_type = other DNA
cttctgtttttaagtcttcc

SEQ ID NO: 2958 - DNA, 20 bp, synthetic construct
  source 1..20: mol_type = other DNA
gcaggcaatcccattttctc

SEQ ID NO: 2959 - DNA, 20 bp, synthetic construct
  source 1..20: mol_type = other DNA
ggagagaaaaatgttctttt

SEQ ID NO: 2960 - DNA, 20 bp, synthetic construct
  source 1..20: mol_type = other DNA
gctcatcttcaaaatctaat

SEQ ID NO: 2961 - DNA, 20 bp, synthetic construct
  source 1..20: mol_type = other DNA
atttattgtcacatactagt

SEQ ID NO: 2962 - DNA, 20 bp, synthetic construct
  source 1..20: mol_type = other DNA
cacatatataaatgtcttta

SEQ ID NO: 2963 - DNA, 20 bp, synthetic construct
  source 1..20: mol_type = other DNA
gaaagtactattttcaatgg

SEQ ID NO: 2964 - DNA, 20 bp, synthetic construct
  source 1..20: mol_type = other DNA
atgagttgtaaatagtgata

SEQ ID NO: 2965 - DNA, 20 bp, synthetic construct
  source 1..20: mol_type = other DNA
actgcggttcctcccccggg

SEQ ID NO: 2966 - DNA, 20 bp, synthetic construct
  source 1..20: mol_type = other DNA
agtcattttatatatttaga

SEQ ID NO: 2967 - DNA, 20 bp, synthetic construct
  source 1..20: mol_type = other DNA
gaaatccaaacattccttga

SEQ ID NO: 2968 - DNA, 20 bp, synthetic construct
  source 1..20: mol_type = other DNA
gccctgttttcacctggtgc

SEQ ID NO: 2969 - DNA, 20 bp, synthetic construct
  source 1..20: mol_type = other DNA
tttccctatgccagaaacac

SEQ ID NO: 2970 - DNA, 20 bp, synthetic construct
  source 1..20: mol_type = other DNA
ttctatatacaaaaaaacat

SEQ ID NO: 2971 - DNA, 20 bp, synthetic construct
  source 1..20: mol_type = other DNA
tccccccatttaaatgaggt

SEQ ID NO: 2972 - DNA, 20 bp, synthetic construct
  source 1..20: mol_type = other DNA
cacttaattttaatacagtt

SEQ ID NO: 2973 - DNA, 20 bp, synthetic construct
  source 1..20: mol_type = other DNA
gcagtattcacagaactgaa

SEQ ID NO: 2974 - DNA, 20 bp, synthetic construct
  source 1..20: mol_type = other DNA
gcacttaaaattttcttttc

SEQ ID NO: 2975 - DNA, 20 bp, synthetic construct
  source 1..20: mol_type = other DNA
tgttttattataataatgaa

SEQ ID NO: 2976 - DNA, 20 bp, synthetic construct
  source 1..20: mol_type = other DNA
acatcaaaacgatttctact

SEQ ID NO: 2977 - DNA, 20 bp, synthetic construct
  source 1..20: mol_type = other DNA
aaccaaaaccaaaagcctct

SEQ ID NO: 2978 - DNA, 20 bp, synthetic construct
  source 1..20: mol_type = other DNA
aatctaaaatacatctgcat

SEQ ID NO: 2979 - DNA, 20 bp, synthetic construct
  source 1..20: mol_type = other DNA
cagtttatttaaagatataa

SEQ ID NO: 2980 - DNA, 20 bp, synthetic construct
  source 1..20: mol_type = other DNA
atcagtaaagaattgatgtc

SEQ ID NO: 2981 - DNA, 20 bp, synthetic construct
  source 1..20: mol_type = other DNA
cttcataaaattccattctg

SEQ ID NO: 2982 - DNA, 20 bp, synthetic construct
  source 1..20: mol_type = other DNA
gctttcataatataacaacc

SEQ ID NO: 2983 - DNA, 20 bp, synthetic construct
  source 1..20: mol_type = other DNA
atcaacaaaattatgtatgg

SEQ ID NO: 2984 - DNA, 20 bp, synthetic construct
  source 1..20: mol_type = other DNA
ggaaacaaccaaagtttttt

SEQ ID NO: 2985 - DNA, 20 bp, synthetic construct
  source 1..20: mol_type = other DNA
ctgtagttttaaaagtgcct

SEQ ID NO: 2986 - DNA, 20 bp, synthetic construct
  source 1..20: mol_type = other DNA
accatatttctttagaaggt

SEQ ID NO: 2987 - DNA, 20 bp, synthetic construct
  source 1..20: mol_type = other DNA
gtgaccaaaatacatatact

SEQ ID NO: 2988 - DNA, 20 bp, synthetic construct
  source 1..20: mol_type = other DNA
actggatttatttaagtctt

SEQ ID NO: 2989 - DNA, 20 bp, synthetic construct
  source 1..20: mol_type = other DNA
gagtcttgcccttaagaagc

SEQ ID NO: 2990 - DNA, 20 bp, synthetic construct
  source 1..20: mol_type = other DNA
ttgatatttcaaaagagcta

SEQ ID NO: 2991 - DNA, 20 bp, synthetic construct
  source 1..20: mol_type = other DNA
atgtaaatattttagcacag

SEQ ID NO: 2992 - DNA, 20 bp, synthetic construct
  source 1..20: mol_type = other DNA
gactaattttaaaatatgct

SEQ ID NO: 2993 - DNA, 20 bp, synthetic construct
  source 1..20: mol_type = other DNA
gagataaaaattatgtagtt

SEQ ID NO: 2994 - DNA, 20 bp, synthetic construct
  source 1..20: mol_type = other DNA
tgggataatatttataagtg

SEQ ID NO: 2995 - DNA, 20 bp, synthetic construct
  source 1..20: mol_type = other DNA
atcttaatcacagaattcaa

SEQ ID NO: 2996 - DNA, 20 bp, synthetic construct
  source 1..20: mol_type = other DNA
tgtctgctgatctatctgtt

SEQ ID NO: 2997 - DNA, 20 bp, synthetic construct
  source 1..20: mol_type = other DNA
ttagggctgccttccatctg

SEQ ID NO: 2998 - DNA, 20 bp, synthetic construct
  source 1..20: mol_type = other DNA
cagctgactttaccccaagc

SEQ ID NO: 2999 - DNA, 20 bp, synthetic construct
  source 1..20: mol_type = other DNA
gcatttaagaaatgctcaaa

SEQ ID NO: 3000 - DNA, 20 bp, synthetic construct
  source 1..20: mol_type = other DNA
gtttattttccatgtgtcac

SEQ ID NO: 3001 - DNA, 20 bp, synthetic construct
  source 1..20: mol_type = other DNA
ctccccaagaacagaagagg

SEQ ID NO: 3002 - DNA, 20 bp, synthetic construct
  source 1..20: mol_type = other DNA
aggaagattcttcaggctag

SEQ ID NO: 3003 - DNA, 20 bp, synthetic construct
  source 1..20: mol_type = other DNA
agacccaaatccgcacccct

SEQ ID NO: 3004 - DNA, 20 bp, synthetic construct
  source 1..20: mol_type = other DNA
tccccaaactaaacacccct

SEQ ID NO: 3005 - DNA, 20 bp, synthetic construct
  source 1..20: mol_type = other DNA
tacttcctacccaaggagga

SEQ ID NO: 3006 - DNA, 20 bp, synthetic construct
  source 1..20: mol_type = other DNA
ggattccaccccgaggatta

SEQ ID NO: 3007 - DNA, 20 bp, synthetic construct
  source 1..20: mol_type = other DNA
ccctaataacacagagcctg

SEQ ID NO: 3008 - DNA, 20 bp, synthetic construct
  source 1..20: mol_type = other DNA
gcagtcaccaactatctatt

SEQ ID NO: 3009 - DNA, 20 bp, synthetic construct
  source 1..20: mol_type = other DNA
atcagttgtaaccaatctat

SEQ ID NO: 3010 - DNA, 20 bp, synthetic construct
  source 1..20: mol_type = other DNA
tcagtaaacccacaccctag

SEQ ID NO: 3011 - DNA, 20 bp, synthetic construct
  source 1..20: mol_type = other DNA
ggcgaaattattaaattggg

SEQ ID NO: 3012 - DNA, 20 bp, synthetic construct
  source 1..20: mol_type = other DNA
tttgattgtatatttcaatc

SEQ ID NO: 3013 - DNA, 20 bp, synthetic construct
  source 1..20: mol_type = other DNA
gatggacgaacctagacagg

SEQ ID NO: 3014 - DNA, 20 bp, synthetic construct
  source 1..20: mol_type = other DNA
atcctgtttcaaacacccta

SEQ ID NO: 3015 - DNA, 20 bp, synthetic construct
  source 1..20: mol_type = other DNA
ttttattgaatcacacttca

SEQ ID NO: 3016 - DNA, 20 bp, synthetic construct
  source 1..20: mol_type = other DNA
tccctcttcccatcctgcca

SEQ ID NO: 3017 - DNA, 20 bp, synthetic construct
  source 1..20: mol_type = other DNA
gcatgtgccccttactccct

SEQ ID NO: 3018 - DNA, 20 bp, synthetic construct
  source 1..20: mol_type = other DNA
tcccatgttcttccccatct

SEQ ID NO: 3019 - DNA, 20 bp, synthetic construct
  source 1..20: mol_type = other DNA
agcttcaaaatattgttatt

SEQ ID NO: 3020 - DNA, 20 bp, synthetic construct
  source 1..20: mol_type = other DNA
ataaggatataaacattctt

SEQ ID NO: 3021 - DNA, 20 bp, synthetic construct
  source 1..20: mol_type = other DNA
ggagcggaagattattcaga

SEQ ID NO: 3022 - DNA, 20 bp, synthetic construct
  source 1..20: mol_type = other DNA
ctccaaatctccaaagacag

SEQ ID NO: 3023 - DNA, 20 bp, synthetic construct
  source 1..20: mol_type = other DNA
ttcttgaaccctcactggtg

SEQ ID NO: 3024 - DNA, 20 bp, synthetic construct
  source 1..20: mol_type = other DNA
ccgcatctcaaaactccaaa

SEQ ID NO: 3025 - DNA, 20 bp, synthetic construct
  source 1..20: mol_type = other DNA
ggtgtgtgagccacattata

SEQ ID NO: 3026 - DNA, 20 bp, synthetic construct
  source 1..20: mol_type = other DNA
ggctccatagatcctcttgc

SEQ ID NO: 3027 - DNA, 20 bp, synthetic construct
  source 1..20: mol_type = other DNA
tgacctctacccttgtgagc

SEQ ID NO: 3028 - DNA, 20 bp, synthetic construct
  source 1..20: mol_type = other DNA
tgttgcttttctacttcatc

SEQ ID NO: 3029 - DNA, 20 bp, synthetic construct
  source 1..20: mol_type = other DNA
ctctagaacaaaatacatat

SEQ ID NO: 3030 - DNA, 20 bp, synthetic construct
  source 1..20: mol_type = other DNA
tctgtttttaaaagatccat

SEQ ID NO: 3031 - DNA, 20 bp, synthetic construct
  source 1..20: mol_type = other DNA
aacaggcctttcaaggtctg

SEQ ID NO: 3032 - DNA, 20 bp, synthetic construct
  source 1..20: mol_type = other DNA
agtgtgtttatcactgagtc

SEQ ID NO: 3033 - DNA, 20 bp, synthetic construct
  source 1..20: mol_type = other DNA
cttgtttgattttatgcaca

SEQ ID NO: 3034 - DNA, 20 bp, synthetic construct
  source 1..20: mol_type = other DNA
atcttctgtttttaagtctt

SEQ ID NO: 3035 - DNA, 20 bp, synthetic construct
  source 1..20: mol_type = other DNA
tgcaggcaatcccattttct

SEQ ID NO: 3036 - DNA, 20 bp, synthetic construct
  source 1..20: mol_type = other DNA
ttggagagaaaaatgttctt

SEQ ID NO: 3037 - DNA, 20 bp, synthetic construct
  source 1..20: mol_type = other DNA
atgctcatcttcaaaatcta

SEQ ID NO: 3038 - DNA, 20 bp, synthetic construct
  source 1..20: mol_type = other DNA
tggtcatttattgtcacata

SEQ ID NO: 3039 - DNA, 20 bp, synthetic construct
  source 1..20: mol_type = other DNA
tgctcacatatataaatgtc

SEQ ID NO: 3040 - DNA, 20 bp, synthetic construct
  source 1..20: mol_type = other DNA
gttgataccagatttttttt

SEQ ID NO: 3041 - DNA, 20 bp, synthetic construct
  source 1..20: mol_type = other DNA
agtcaattcaatactcgaag

SEQ ID NO: 3042 - DNA, 20 bp, synthetic construct
  source 1..20: mol_type = other DNA
tccacattcactattccgtg

SEQ ID NO: 3043 - DNA, 20 bp, synthetic construct
  source 1..20: mol_type = other DNA
acagtcattttatatattta

SEQ ID NO: 3044 - DNA, 20 bp, synthetic construct
  source 1..20: mol_type = other DNA
caggaaatccaaacattcct

SEQ ID NO: 3045 - DNA, 20 bp, synthetic construct
  source 1..20: mol_type = other DNA
tcacatcaccaccgaagaaa

SEQ ID NO: 3046 - DNA, 20 bp, synthetic construct
  source 1..20: mol_type = other DNA
ttggagtttccctatgccag

SEQ ID NO: 3047 - DNA, 20 bp, synthetic construct
  source 1..20: mol_type = other DNA
gacaaatttctatatacaaa

SEQ ID NO: 3048 - DNA, 20 bp, synthetic construct
  source 1..20: mol_type = other DNA
actccccccatttaaatgag

SEQ ID NO: 3049 - DNA, 20 bp, synthetic construct
  source 1..20: mol_type = other DNA
gcacttaattttaatacagt

SEQ ID NO: 3050 - DNA, 20 bp, synthetic construct
  source 1..20: mol_type = other DNA
ggcagtattcacagaactga

SEQ ID NO: 3051 - DNA, 20 bp, synthetic construct
  source 1..20: mol_type = other DNA
cttaactattatgtatgcac

SEQ ID NO: 3052 - DNA, 20 bp, synthetic construct
  source 1..20: mol_type = other DNA
ttgttttattataataatga

SEQ ID NO: 3053 - DNA, 20 bp, synthetic construct
  source 1..20: mol_type = other DNA
gcaggtaaaaccaaatgaca

SEQ ID NO: 3054 - DNA, 20 bp, synthetic construct
  source 1..20: mol_type = other DNA
gcaaccaaaaccaaaagcct

SEQ ID NO: 3055 - DNA, 20 bp, synthetic construct
  source 1..20: mol_type = other DNA
gggctattaatttattaaat

SEQ ID NO: 3056 - DNA, 20 bp, synthetic construct
  source 1..20: mol_type = other DNA
aagatcttttaaagtcctac

SEQ ID NO: 3057 - DNA, 20 bp, synthetic construct
  source 1..20: mol_type = other DNA
gtaagctccatttatagaat

SEQ ID NO: 3058 - DNA, 20 bp, synthetic construct
  source 1..20: mol_type = other DNA
cctcacacaccttaaccctg

SEQ ID NO: 3059 - DNA, 20 bp, synthetic construct
  source 1..20: mol_type = other DNA
gagataaaaattattttggc

SEQ ID NO: 3060 - DNA, 20 bp, synthetic construct
  source 1..20: mol_type = other DNA
gctaaatttcattagaaaca

SEQ ID NO: 3061 - DNA, 20 bp, synthetic construct
  source 1..20: mol_type = other DNA
ttttctacaatttataggcg

SEQ ID NO: 3062 - DNA, 20 bp, synthetic construct
  source 1..20: mol_type = other DNA
ctgcaccaaatttatttttg

SEQ ID NO: 3063 - DNA, 20 bp, synthetic construct
  source 1..20: mol_type = other DNA
actgaaaaaactgtatgatc

SEQ ID NO: 3064 - DNA, 20 bp, synthetic construct
  source 1..20: mol_type = other DNA
ccttttaaaatttccagaaa

SEQ ID NO: 3065 - DNA, 20 bp, synthetic construct
  source 1..20: mol_type = other DNA
gaagttagccaggcatcagg

SEQ ID NO: 3066 - DNA, 20 bp, synthetic construct
  source 1..20: mol_type = other DNA
gcagagttttaaaatgcact

SEQ ID NO: 3067 - DNA, 20 bp, synthetic construct
  source 1..20: mol_type = other DNA
aggcatagtatttagcagaa

SEQ ID NO: 3068 - DNA, 20 bp, synthetic construct
  source 1..20: mol_type = other DNA
tacttctttccttaagcaca

SEQ ID NO: 3069 - DNA, 20 bp, synthetic construct
  source 1..20: mol_type = other DNA
tagtttaaaatatgtgactc

SEQ ID NO: 3070 - DNA, 20 bp, synthetic construct
  source 1..20: mol_type = other DNA
ccagaaaaaccttaaactac

SEQ ID NO: 3071 - DNA, 20 bp, synthetic construct
  source 1..20: mol_type = other DNA
accttcaaactatcaattct

SEQ ID NO: 3072 - DNA, 20 bp, synthetic construct
  source 1..20: mol_type = other DNA
ttcctcatcttaatcacaga

SEQ ID NO: 3073 - DNA, 20 bp, synthetic construct
  source 1..20: mol_type = other DNA
gagagtataaaaattatctc

SEQ ID NO: 3074 - DNA, 20 bp, synthetic construct
  source 1..20: mol_type = other DNA
gtccatcacacttagggctg

SEQ ID NO: 3075 - DNA, 20 bp, synthetic construct
  source 1..20: mol_type = other DNA
ctacagctgactttacccca

SEQ ID NO: 3076 - DNA, 20 bp, synthetic construct
  source 1..20: mol_type = other DNA
ttgggcatttaagaaatgct

SEQ ID NO: 3077 - DNA, 20 bp, synthetic construct
  source 1..20: mol_type = other DNA
atgtttattttccatgtgtc

SEQ ID NO: 3078 - DNA, 20 bp, synthetic construct
  source 1..20: mol_type = other DNA
cttcctccccaagaacagaa

SEQ ID NO: 3079 - DNA, 20 bp, synthetic construct
  source 1..20: mol_type = other DNA
cagtgcctaaccagttgaga

SEQ ID NO: 3080 - DNA, 20 bp, synthetic construct
  source 1..20: mol_type = other DNA
ccagagacccaaatccgcac

SEQ ID NO: 3081 - DNA, 20 bp, synthetic construct
  source 1..20: mol_type = other DNA
catccccaaactaaacaccc

SEQ ID NO: 3082 - DNA, 20 bp, synthetic construct
  source 1..20: mol_type = other DNA
ctaacctacttcctacccaa

SEQ ID NO: 3083 - DNA, 20 bp, synthetic construct
  source 1..20: mol_type = other DNA
agccttagaaacaggaacgg

SEQ ID NO: 3084 - DNA, 20 bp, synthetic construct
  source 1..20: mol_type = other DNA
gccctaataacacagagcct

SEQ ID NO: 3085 - DNA, 20 bp, synthetic construct
  source 1..20: mol_type = other DNA
cggcacaaatccagggctgg

SEQ ID NO: 3086 - DNA, 20 bp, synthetic construct
  source 1..20: mol_type = other DNA
tagttaaaaataaggtatcg

SEQ ID NO: 3087 - DNA, 20 bp, synthetic construct
  source 1..20: mol_type = other DNA
ttcagtaaacccacacccta

SEQ ID NO: 3088 - DNA, 20 bp, synthetic construct
  source 1..20: mol_type = other DNA
tggcgaaattattaaattgg

SEQ ID NO: 3089 - DNA, 20 bp, synthetic construct
  source 1..20: mol_type = other DNA
cacgcatatttatgctgttt

SEQ ID NO: 3090 - DNA, 20 bp, synthetic construct
  source 1..20: mol_type = other DNA
ggatggacgaacctagacag

SEQ ID NO: 3091 - DNA, 20 bp, synthetic construct
  source 1..20: mol_type = other DNA
atatcctgtttcaaacaccc

SEQ ID NO: 3092 - DNA, 20 bp, synthetic construct
  source 1..20: mol_type = other DNA
gattttattgaatcacactt

SEQ ID NO: 3093 - DNA, 20 bp, synthetic construct
  source 1..20: mol_type = other DNA
caaccattccagactgagct

SEQ ID NO: 3094 - DNA, 20 bp, synthetic construct
  source 1..20: mol_type = other DNA
acatgcaagcctgatgtggt

SEQ ID NO: 3095 - DNA, 20 bp, synthetic construct
  source 1..20: mol_type = other DNA
ctaaaacacaccagacctcc

SEQ ID NO: 3096 - DNA, 20 bp, synthetic construct
  source 1..20: mol_type = other DNA
tagcttcaaaatattgttat

SEQ ID NO: 3097 - DNA, 20 bp, synthetic construct
  source 1..20: mol_type = other DNA
taggtttgtcataaggatat

SEQ ID NO: 3098 - DNA, 20 bp, synthetic construct
  source 1..20: mol_type = other DNA
gccacgaccagatatcagct

SEQ ID NO: 3099 - DNA, 20 bp, synthetic construct
  source 1..20: mol_type = other DNA
actccaaatctccaaagaca

SEQ ID NO: 3100 - DNA, 20 bp, synthetic construct
  source 1..20: mol_type = other DNA
cttcttgaaccctcactggt

SEQ ID NO: 3101 - DNA, 20 bp, synthetic construct
  source 1..20: mol_type = other DNA
tccgcatctcaaaactccaa

SEQ ID NO: 3102 - DNA, 20 bp, synthetic construct
  source 1..20: mol_type = other DNA
ggacacctacccatggagag

SEQ ID NO: 3103 - DNA, 20 bp, synthetic construct
  source 1..20: mol_type = other DNA
actgtattctaagtaggagg

SEQ ID NO: 3104 - DNA, 20 bp, synthetic construct
  source 1..20: mol_type = other DNA
cctcctgacctctacccttg

SEQ ID NO: 3105 - DNA, 20 bp, synthetic construct
  source 1..20: mol_type = other DNA
gatttccacagattgttgct

SEQ ID NO: 3106 - DNA, 20 bp, synthetic construct
  source 1..20: mol_type = other DNA
cctctagaacaaaatacata

SEQ ID NO: 3107 - DNA, 20 bp, synthetic construct
  source 1..20: mol_type = other DNA
atctgtttttaaaagatcca

SEQ ID NO: 3108 - DNA, 20 bp, synthetic construct
  source 1..20: mol_type = other DNA
aaccacaagccaacaggcct

SEQ ID NO: 3109 - DNA, 20 bp, synthetic construct
  source 1..20: mol_type = other DNA
tgtgagttccaagaagcagg

SEQ ID NO: 3110 - DNA, 20 bp, synthetic construct
  source 1..20: mol_type = other DNA
cattttattcttgtttgatt

SEQ ID NO: 3111 - DNA, 20 bp, synthetic construct
  source 1..20: mol_type = other DNA
ctgttgctctggctgctgct

SEQ ID NO: 3112 - DNA, 20 bp, synthetic construct
  source 1..20: mol_type = other DNA
ttgcggctgctgttgctctg

SEQ ID NO: 3113 - DNA, 20 bp, synthetic construct
  source 1..20: mol_type = other DNA
caatgtcttgcggctgctgt

SEQ ID NO: 3114 - DNA, 20 bp, synthetic construct
  source 1..20: mol_type = other DNA
cctggtgacttgatgcacga

SEQ ID NO: 3115 - DNA, 20 bp, synthetic construct
  source 1..20: mol_type = other DNA
atcagttccttgcagcagat

SEQ ID NO: 3116 - DNA, 20 bp, synthetic construct
  source 1..20: mol_type = other DNA
ccataagctatcagttcctt

SEQ ID NO: 3117 - DNA, 20 bp, synthetic construct
  source 1..20: mol_type = other DNA
tggagaaccataagctatca

SEQ ID NO: 3118 - DNA, 20 bp, synthetic construct
  source 1..20: mol_type = other DNA
catgtgctttcatcacaatg

SEQ ID NO: 3119 - DNA, 20 bp, synthetic construct
  source 1..20: mol_type = other DNA
ctgtaccatgtgctttcatc

SEQ ID NO: 3120 - DNA, 20 bp, synthetic construct
  source 1..20: mol_type = other DNA
taaatactgtgttattttag

SEQ ID NO: 3121 - DNA, 20 bp, synthetic construct
  source 1..20: mol_type = other DNA
ggtatttgttcagtttagtt

SEQ ID NO: 3122 - DNA, 20 bp, synthetic construct
  source 1..20: mol_type = other DNA
aagtcaggtatttgttcagt

SEQ ID NO: 3123 - DNA, 20 bp, synthetic construct
  source 1..20: mol_type = other DNA
gtttagtggatccagtcaat

SEQ ID NO: 3124 - DNA, 20 bp, synthetic construct
  source 1..20: mol_type = other DNA
agtgttggtttagtggatcc

SEQ ID NO: 3125 - DNA, 20 bp, synthetic construct
  source 1..20: mol_type = other DNA
tcccatcttagtgttggttt

SEQ ID NO: 3126 - DNA, 20 bp, synthetic construct
  source 1..20: mol_type = other DNA
ttagagattgttgttattgt

SEQ ID NO: 3127 - DNA, 20 bp, synthetic construct
  source 1..20: mol_type = other DNA
aaattcttagagattgttgt

SEQ ID NO: 3128 - DNA, 20 bp, synthetic construct
  source 1..20: mol_type = other DNA
tgatctgatattaaaacatc

SEQ ID NO: 3129 - DNA, 20 bp, synthetic construct
  source 1..20: mol_type = other DNA
tgggtaatgatctgatatta

SEQ ID NO: 3130 - DNA, 20 bp, synthetic construct
  source 1..20: mol_type = other DNA
ggcatatggtgggtaatgat

SEQ ID NO: 3131 - DNA, 20 bp, synthetic construct
  source 1..20: mol_type = other DNA
agtagtttttgtgaggtaaa

SEQ ID NO: 3132 - DNA, 20 bp, synthetic construct
  source 1..20: mol_type = other DNA
gcttgtagtagtttttgtga

SEQ ID NO: 3133 - DNA, 20 bp, synthetic construct
  source 1..20: mol_type = other DNA
ttttctatttgcactagctg

SEQ ID NO: 3134 - DNA, 20 bp, synthetic construct
  source 1..20: mol_type = other DNA
atgtcaccttttctatttgc

SEQ ID NO: 3135 - DNA, 20 bp, synthetic construct
  source 1..20: mol_type = other DNA
aaacactagaaatccaggga

SEQ ID NO: 3136 - DNA, 20 bp, synthetic construct
  source 1..20: mol_type = other DNA
tgctatgctcacagagaacc

SEQ ID NO: 3137 - DNA, 20 bp, synthetic construct
  source 1..20: mol_type = other DNA
tacagttagtttgatatgct

SEQ ID NO: 3138 - DNA, 20 bp, synthetic construct
  source 1..20: mol_type = other DNA
ggaataaattatttactgcg

SEQ ID NO: 3139 - DNA, 20 bp, synthetic construct
  source 1..20: mol_type = other DNA
tactatgtatttgccacagt

SEQ ID NO: 3140 - DNA, 20 bp, synthetic construct
  source 1..20: mol_type = other DNA
atatttaatcatgttcccga

SEQ ID NO: 3141 - DNA, 20 bp, synthetic construct
  source 1..20: mol_type = other DNA
atagttatatttaatcatgt

SEQ ID NO: 3142 - DNA, 20 bp, synthetic construct
  source 1..20: mol_type = other DNA
atatgtatacaattctgaca

SEQ ID NO: 3143 - DNA, 20 bp, synthetic construct
  source 1..20: mol_type = other DNA
caatgttctcaggtttatat

SEQ ID NO: 3144 - DNA, 20 bp, synthetic construct
  source 1..20: mol_type = other DNA
cctttcttctttgttcatag

SEQ ID NO: 3145 - DNA, 20 bp, synthetic construct
  source 1..20: mol_type = other DNA
cttgttcctttcttctttgt

SEQ ID NO: 3146 - DNA, 20 bp, synthetic construct
  source 1..20: mol_type = other DNA
atttatcctcaggatgcaaa

SEQ ID NO: 3147 - DNA, 20 bp, synthetic construct
  source 1..20: mol_type = other DNA
tttgtttagatttatcctca

SEQ ID NO: 3148 - DNA, 20 bp, synthetic construct
  source 1..20: mol_type = other DNA
atactccatttttccttcta

SEQ ID NO: 3149 - DNA, 20 bp, synthetic construct
  source 1..20: mol_type = other DNA
atgtgtaatactccattttt

SEQ ID NO: 3150 - DNA, 20 bp, synthetic construct
  source 1..20: mol_type = other DNA
ttattacaaatgtgtaatac

SEQ ID NO: 3151 - DNA, 20 bp, synthetic construct
  source 1..20: mol_type = other DNA
tatgttagtcatttctctct

SEQ ID NO: 3152 - DNA, 20 bp, synthetic construct
  source 1..20: mol_type = other DNA
caagtctatgttagtcattt

SEQ ID NO: 3153 - DNA, 20 bp, synthetic construct
  source 1..20: mol_type = other DNA
taaggtattttcatggagtt

SEQ ID NO: 3154 - DNA, 20 bp, synthetic construct
  source 1..20: mol_type = other DNA
ttgtaacagttatgtttaag

SEQ ID NO: 3155 - DNA, 20 bp, synthetic construct
  source 1..20: mol_type = other DNA
tttactcattctaccttcaa

SEQ ID NO: 3156 - DNA, 20 bp, synthetic construct
  source 1..20: mol_type = other DNA
ttggttatttactcattcta

SEQ ID NO: 3157 - DNA, 20 bp, synthetic construct
  source 1..20: mol_type = other DNA
tccataaacttggttattta

SEQ ID NO: 3158 - DNA, 20 bp, synthetic construct
  source 1..20: mol_type = other DNA
ttagcttttcaaatactaaa

SEQ ID NO: 3159 - DNA, 20 bp, synthetic construct
  source 1..20: mol_type = other DNA
tcagcatacttagcttttca

SEQ ID NO: 3160 - DNA, 20 bp, synthetic construct
  source 1..20: mol_type = other DNA
gacagtgtcagcatacttag

SEQ ID NO: 3161 - DNA, 20 bp, synthetic construct
  source 1..20: mol_type = other DNA
tacccaggttattacactgt

SEQ ID NO: 3162 - DNA, 20 bp, synthetic construct
  source 1..20: mol_type = other DNA
ttgggtttttctgtacaaag

SEQ ID NO: 3163 - DNA, 20 bp, synthetic construct
  source 1..20: mol_type = other DNA
ttttgtttgggtttttctgt

SEQ ID NO: 3164 - DNA, 20 bp, synthetic construct
  source 1..20: mol_type = other DNA
ctagttcttatcactattca

SEQ ID NO: 3165 - DNA, 20 bp, synthetic construct
  source 1..20: mol_type = other DNA
atgtcaactagttcttatca

SEQ ID NO: 3166 - DNA, 20 bp, synthetic construct
  source 1..20: mol_type = other DNA
gactaaacaatgtcaactag

SEQ ID NO: 3167 - DNA, 20 bp, synthetic construct
  source 1..20: mol_type = other DNA
tgggtttttagttttccttc

SEQ ID NO: 3168 - DNA, 20 bp, synthetic construct
  source 1..20: mol_type = other DNA
aggtcctgggtttttagttt

SEQ ID NO: 3169 - DNA, 20 bp, synthetic construct
  source 1..20: mol_type = other DNA
taaatgactgtggtgcagcc

SEQ ID NO: 3170 - DNA, 20 bp, synthetic construct
  source 1..20: mol_type = other DNA
aagccagtgtttgcattaaa

SEQ ID NO: 3171 - DNA, 20 bp, synthetic construct
  source 1..20: mol_type = other DNA
aagggccactaaatctgacc

SEQ ID NO: 3172 - DNA, 20 bp, synthetic construct
  source 1..20: mol_type = other DNA
atttcttttttttttaagtt

SEQ ID NO: 3173 - DNA, 20 bp, synthetic construct
  source 1..20: mol_type = other DNA
gtgtttgatatttctttttt

SEQ ID NO: 3174 - DNA, 20 bp, synthetic construct
  source 1..20: mol_type = other DNA
ctttcaaatgtgtttgatat

SEQ ID NO: 3175 - DNA, 20 bp, synthetic construct
  source 1..20: mol_type = other DNA
ttataacaatttgcatagtc

SEQ ID NO: 3176 - DNA, 20 bp, synthetic construct
  source 1..20: mol_type = other DNA
gggagtattataacaatttg

SEQ ID NO: 3177 - DNA, 20 bp, synthetic construct
  source 1..20: mol_type = other DNA
tattttccagggagtattat

SEQ ID NO: 3178 - DNA, 20 bp, synthetic construct
  source 1..20: mol_type = other DNA
cattatctagtttctggaaa

SEQ ID NO: 3179 - DNA, 20 bp, synthetic construct
  source 1..20: mol_type = other DNA
aatggtcattatctagtttc

SEQ ID NO: 3180 - DNA, 20 bp, synthetic construct
  source 1..20: mol_type = other DNA
ctaaatctgacttacaaagg

SEQ ID NO: 3181 - DNA, 20 bp, synthetic construct
  source 1..20: mol_type = other DNA
taaaaccaatacattaacat

SEQ ID NO: 3182 - DNA, 20 bp, synthetic construct
  source 1..20: mol_type = other DNA
cattatgctttaagatcaca

SEQ ID NO: 3183 - DNA, 20 bp, synthetic construct
  source 1..20: mol_type = other DNA
aacaatgtcttgcggctgct

SEQ ID NO: 3184 - DNA, 20 bp, synthetic construct
  source 1..20: mol_type = other DNA
tgacttgatgcacgatgctc

SEQ ID NO: 3185 - DNA, 20 bp, synthetic construct
  source 1..20: mol_type = other DNA
ccctggtgacttgatgcacg

SEQ ID NO: 3186 - DNA, 20 bp, synthetic construct
  source 1..20: mol_type = other DNA
ctatcagttccttgcagcag

SEQ ID NO: 3187 - DNA, 20 bp, synthetic construct
  source 1..20: mol_type = other DNA
aatggagaaccataagctat

SEQ ID NO: 3188 - DNA, 20 bp, synthetic construct
  source 1..20: mol_type = other DNA
ccatgtgctttcatcacaat

SEQ ID NO: 3189 - DNA, 20 bp, synthetic construct
  source 1..20: mol_type = other DNA
actgtaccatgtgctttcat

SEQ ID NO: 3190 - DNA, 20 bp, synthetic construct
  source 1..20: mol_type = other DNA
ttcagtttagttgcagccat

SEQ ID NO: 3191 - DNA, 20 bp, synthetic construct
  source 1..20: mol_type = other DNA
aggtatttgttcagtttagt

SEQ ID NO: 3192 - DNA, 20 bp, synthetic construct
  source 1..20: mol_type = other DNA
aaaagtcaggtatttgttca

SEQ ID NO: 3193 - DNA, 20 bp, synthetic construct
  source 1..20: mol_type = other DNA
tggtttagtggatccagtca

SEQ ID NO: 3194 - DNA, 20 bp, synthetic construct
  source 1..20: mol_type = other DNA
tagtgttggtttagtggatc

SEQ ID NO: 3195 - DNA, 20 bp, synthetic construct
  source 1..20: mol_type = other DNA
tgttgttattgtatagatac

SEQ ID NO: 3196 - DNA, 20 bp, synthetic construct
  source 1..20: mol_type = other DNA
cttagagattgttgttattg

SEQ ID NO: 3197 - DNA, 20 bp, synthetic construct
  source 1..20: mol_type = other DNA
ggaaattcttagagattgtt

SEQ ID NO: 3198 - DNA, 20 bp, synthetic construct
  source 1..20: mol_type = other DNA
aatgatctgatattaaaaca

SEQ ID NO: 3199 - DNA, 20 bp, synthetic construct
  source 1..20: mol_type = other DNA
gtgggtaatgatctgatatt

SEQ ID NO: 3200 - DNA, 20 bp, synthetic construct
  source 1..20: mol_type = other DNA
ttgtgaggtaaaactgtaaa

SEQ ID NO: 3201 - DNA, 20 bp, synthetic construct
  source 1..20: mol_type = other DNA
tagtagtttttgtgaggtaa

SEQ ID NO: 3202 - DNA, 20 bp, synthetic construct
  source 1..20: mol_type = other DNA
ccttttctatttgcactagc

SEQ ID NO: 3203 - DNA, 20 bp, synthetic construct
  source 1..20: mol_type = other DNA
aatgtcaccttttctatttg

SEQ ID NO: 3204 - DNA, 20 bp, synthetic construct
  source 1..20: mol_type = other DNA
aactctcttaagtacttata

SEQ ID NO: 3205 - DNA, 20 bp, synthetic construct
  source 1..20: mol_type = other DNA
tatgctatgctcacagagaa

SEQ ID NO: 3206 - DNA, 20 bp, synthetic construct
  source 1..20: mol_type = other DNA
agtttgatatgctatgctca

SEQ ID NO: 3207 - DNA, 20 bp, synthetic construct
  source 1..20: mol_type = other DNA
cttacagttagtttgatatg

SEQ ID NO: 3208 - DNA, 20 bp, synthetic construct
  source 1..20: mol_type = other DNA
agcttccagataaaacctcc

SEQ ID NO: 3209 - DNA, 20 bp, synthetic construct
  source 1..20: mol_type = other DNA
ttcaaaattctcagcattgg

SEQ ID NO: 3210 - DNA, 20 bp, synthetic construct
  source 1..20: mol_type = other DNA
tatatttaatcatgttcccg

SEQ ID NO: 3211 - DNA, 20 bp, synthetic construct
  source 1..20: mol_type = other DNA
ttatatgtatacaattctga

SEQ ID NO: 3212 - DNA, 20 bp, synthetic construct
  source 1..20: mol_type = other DNA
ctcaggtttatatgtataca

SEQ ID NO: 3213 - DNA, 20 bp, synthetic construct
  source 1..20: mol_type = other DNA
ggcaatgttctcaggtttat

SEQ ID NO: 3214 - DNA, 20 bp, synthetic construct
  source 1..20: mol_type = other DNA
tcctttcttctttgttcata

SEQ ID NO: 3215 - DNA, 20 bp, synthetic construct
  source 1..20: mol_type = other DNA
tcttgttcctttcttctttg

SEQ ID NO: 3216 - DNA, 20 bp, synthetic construct
  source 1..20: mol_type = other DNA
agatttatcctcaggatgca

SEQ ID NO: 3217 - DNA, 20 bp, synthetic construct
  source 1..20: mol_type = other DNA
taatactccatttttccttc

SEQ ID NO: 3218 - DNA, 20 bp, synthetic construct
  source 1..20: mol_type = other DNA
aatgtgtaatactccatttt

SEQ ID NO: 3219 - DNA, 20 bp, synthetic construct
  source 1..20: mol_type = other DNA
tcatttctctctggctgtgc

SEQ ID NO: 3220 - DNA, 20 bp, synthetic construct
  source 1..20: mol_type = other DNA
ctatgttagtcatttctctc

SEQ ID NO: 3221 - DNA, 20 bp, synthetic construct
  source 1..20: mol_type = other DNA
atcaagtctatgttagtcat

SEQ ID NO: 3222 - DNA, 20 bp, synthetic construct
  source 1..20: mol_type = other DNA
tttaaggtattttcatggag

SEQ ID NO: 3223 - DNA, 20 bp, synthetic construct
  source 1..20: mol_type = other DNA
agttatgtttaaggtatttt

SEQ ID NO: 3224 - DNA, 20 bp, synthetic construct
  source 1..20: mol_type = other DNA
acttgtaacagttatgttta

SEQ ID NO: 3225 - DNA, 20 bp, synthetic construct
  source 1..20: mol_type = other DNA
tatttactcattctaccttc

SEQ ID NO: 3226 - DNA, 20 bp, synthetic construct
  source 1..20: mol_type = other DNA
cttggttatttactcattct

SEQ ID NO: 3227 - DNA, 20 bp, synthetic construct
  source 1..20: mol_type = other DNA
ggctgattctagtactgtga

SEQ ID NO: 3228 - DNA, 20 bp, synthetic construct
  source 1..20: mol_type = other DNA
acttagcttttcaaatacta

SEQ ID NO: 3229 - DNA, 20 bp, synthetic construct
  source 1..20: mol_type = other DNA
aggacagtgtcagcatactt

SEQ ID NO: 3230 - DNA, 20 bp, synthetic construct
  source 1..20: mol_type = other DNA
ttctgtacaaagttcagttg

SEQ ID NO: 3231 - DNA, 20 bp, synthetic construct
  source 1..20: mol_type = other DNA
tttgggtttttctgtacaaa

SEQ ID NO: 3232 - DNA, 20 bp, synthetic construct
  source 1..20: mol_type = other DNA
agttttgtttgggtttttct

SEQ ID NO: 3233 - DNA, 20 bp, synthetic construct
  source 1..20: mol_type = other DNA
aactagttcttatcactatt

SEQ ID NO: 3234 - DNA, 20 bp, synthetic construct
  source 1..20: mol_type = other DNA
aatgtcaactagttcttatc

SEQ ID NO: 3235 - DNA, 20 bp, synthetic construct
  source 1..20: mol_type = other DNA
tataaaattcacctaaaatt

SEQ ID NO: 3236 - DNA, 20 bp, synthetic construct
  source 1..20: mol_type = other DNA
ctgggtttttagttttcctt

SEQ ID NO: 3237 - DNA, 20 bp, synthetic construct
  source 1..20: mol_type = other DNA
taggtcctgggtttttagtt

SEQ ID NO: 3238 - DNA, 20 bp, synthetic construct
  source 1..20: mol_type = other DNA
attaaatgactgtggtgcag

SEQ ID NO: 3239 - DNA, 20 bp, synthetic construct
  source 1..20: mol_type = other DNA
tgtttgcattaaatgactgt

SEQ ID NO: 3240 - DNA, 20 bp, synthetic construct
  source 1..20: mol_type = other DNA
aaaagccagtgtttgcatta

SEQ ID NO: 3241 - DNA, 20 bp, synthetic construct
  source 1..20: mol_type = other DNA
taagggccactaaatctgac

SEQ ID NO: 3242 - DNA, 20 bp, synthetic construct
  source 1..20: mol_type = other DNA
atatttcttttttttttaag

SEQ ID NO: 3243 - DNA, 20 bp, synthetic construct
  source 1..20: mol_type = other DNA
tgtgtttgatatttcttttt

SEQ ID NO: 3244 - DNA, 20 bp, synthetic construct
  source 1..20: mol_type = other DNA
atgcaaggtccagggaatac

SEQ ID NO: 3245 - DNA, 20 bp, synthetic construct
  source 1..20: mol_type = other DNA
tattataacaatttgcatag

SEQ ID NO: 3246 - DNA, 20 bp, synthetic construct
  source 1..20: mol_type = other DNA
agggagtattataacaattt

SEQ ID NO: 3247 - DNA, 20 bp, synthetic construct
  source 1..20: mol_type = other DNA
tatgagtaattagcacaaag

SEQ ID NO: 3248 - DNA, 20 bp, synthetic construct
  source 1..20: mol_type = other DNA
tcattatctagtttctggaa

SEQ ID NO: 3249 - DNA, 20 bp, synthetic construct
  source 1..20: mol_type = other DNA
aaatggtcattatctagttt

SEQ ID NO: 3250 - DNA, 20 bp, synthetic construct
  source 1..20: mol_type = other DNA
acttccaattttgaaatact

SEQ ID NO: 3251 - DNA, 20 bp, synthetic construct
  source 1..20: mol_type = other DNA
gaaagccccagcacataaat

SEQ ID NO: 3252 - DNA, 20 bp, synthetic construct
  source 1..20: mol_type = other DNA
tgaaagctggccgatatccc

SEQ ID NO: 3253 - DNA, 20 bp, synthetic construct
  source 1..20: mol_type = other DNA
tcttgcggctgctgttgctc

SEQ ID NO: 3254 - DNA, 20 bp, synthetic construct
  source 1..20: mol_type = other DNA
gaaacaatgtcttgcggctg

SEQ ID NO: 3255 - DNA, 20 bp, synthetic construct
  source 1..20: mol_type = other DNA
gtgacttgatgcacgatgct

SEQ ID NO: 3256 - DNA, 20 bp, synthetic construct
  source 1..20: mol_type = other DNA
accctggtgacttgatgcac

SEQ ID NO: 3257 - DNA, 20 bp, synthetic construct
  source 1..20: mol_type = other DNA
agctatcagttccttgcagc

SEQ ID NO: 3258 - DNA, 20 bp, synthetic construct
  source 1..20: mol_type = other DNA
aaccataagctatcagttcc

SEQ ID NO: 3259 - DNA, 20 bp, synthetic construct
  source 1..20: mol_type = other DNA
acaatggagaaccataagct

SEQ ID NO: 3260 - DNA, 20 bp, synthetic construct
  source 1..20: mol_type = other DNA
accatgtgctttcatcacaa

SEQ ID NO: 3261 - DNA, 20 bp, synthetic construct
  source 1..20: mol_type = other DNA
aactgtaccatgtgctttca

SEQ ID NO: 3262 - DNA, 20 bp, synthetic construct
  source 1..20: mol_type = other DNA
agaaaagtcaggtatttgtt

SEQ ID NO: 3263 - DNA, 20 bp, synthetic construct
  source 1..20: mol_type = other DNA
ttggtttagtggatccagtc

SEQ ID NO: 3264 - DNA, 20 bp, synthetic construct
  source 1..20: mol_type = other DNA
ttagtgttggtttagtggat

SEQ ID NO: 3265 - DNA, 20 bp, synthetic construct
  source 1..20: mol_type = other DNA
attgttgttattgtatagat

SEQ ID NO: 3266 - DNA, 20 bp, synthetic construct
  source 1..20: mol_type = other DNA
atggaaattcttagagattg

SEQ ID NO: 3267 - DNA, 20 bp, synthetic construct
  source 1..20: mol_type = other DNA
taatgatctgatattaaaac

SEQ ID NO: 3268 - DNA, 20 bp, synthetic construct
  source 1..20: mol_type = other DNA
ggtgggtaatgatctgatat

SEQ ID NO: 3269 - DNA, 20 bp, synthetic construct
  source 1..20: mol_type = other DNA
ttttgtgaggtaaaactgta

SEQ ID NO: 3270 - DNA, 20 bp, synthetic construct
  source 1..20: mol_type = other DNA
accttttctatttgcactag

SEQ ID NO: 3271 - DNA, 20 bp, synthetic construct
  source 1..20: mol_type = other DNA
aaatgtcaccttttctattt

SEQ ID NO: 3272 - DNA, 20 bp, synthetic construct
  source 1..20: mol_type = other DNA
gctattttttccagaaagtc

SEQ ID NO: 3273 - DNA, 20 bp, synthetic construct
  source 1..20: mol_type = other DNA
gatatgctatgctcacagag

SEQ ID NO: 3274 - DNA, 20 bp, synthetic construct
  source 1..20: mol_type = other DNA
tagtttgatatgctatgctc

SEQ ID NO: 3275 - DNA, 20 bp, synthetic construct
  source 1..20: mol_type = other DNA
aattttttttaacatcttgc

SEQ ID NO: 3276 - DNA, 20 bp, synthetic construct
  source 1..20: mol_type = other DNA
atcatgttcccgatattgga

SEQ ID NO: 3277 - DNA, 20 bp, synthetic construct
  source 1..20: mol_type = other DNA
ttatatttaatcatgttccc

SEQ ID NO: 3278 - DNA, 20 bp, synthetic construct
  source 1..20: mol_type = other DNA
aacatagttatatttaatca

SEQ ID NO: 3279 - DNA, 20 bp, synthetic construct
  source 1..20: mol_type = other DNA
gtttatatgtatacaattct

SEQ ID NO: 3280 - DNA, 20 bp, synthetic construct
  source 1..20: mol_type = other DNA
tctcaggtttatatgtatac

SEQ ID NO: 3281 - DNA, 20 bp, synthetic construct
  source 1..20: mol_type = other DNA
tcacagggaataatgaagag

SEQ ID NO: 3282 - DNA, 20 bp, synthetic construct
  source 1..20: mol_type = other DNA
ttcctttcttctttgttcat

SEQ ID NO: 3283 - DNA, 20 bp, synthetic construct
  source 1..20: mol_type = other DNA
ctcttgttcctttcttcttt

SEQ ID NO: 3284 - DNA, 20 bp, synthetic construct
  source 1..20: mol_type = other DNA
ttagatttatcctcaggatg

SEQ ID NO: 3285 - DNA, 20 bp, synthetic construct
  source 1..20: mol_type = other DNA
ggtttgtttagatttatcct

SEQ ID NO: 3286 - DNA, 20 bp, synthetic construct
  source 1..20: mol_type = other DNA
gtaatactccatttttcctt

SEQ ID NO: 3287 - DNA, 20 bp, synthetic construct
  source 1..20: mol_type = other DNA
aaatgtgtaatactccattt

SEQ ID NO: 3288 - DNA, 20 bp, synthetic construct
  source 1..20: mol_type = other DNA
agtcatttctctctggctgt

SEQ ID NO: 3289 - DNA, 20 bp, synthetic construct
  source 1..20: mol_type = other DNA
aaatcaagtctatgttagtc

SEQ ID NO: 3290 - DNA, 20 bp, synthetic construct
  source 1..20: mol_type = other DNA
tgtttaaggtattttcatgg

SEQ ID NO: 3291 - DNA, 20 bp, synthetic construct
  source 1..20: mol_type = other DNA
cagttatgtttaaggtattt

SEQ ID NO: 3292 - DNA, 20 bp, synthetic construct
  source 1..20: mol_type = other DNA
ctgttcttagcttcccagct

SEQ ID NO: 3293 - DNA, 20 bp, synthetic construct
  source 1..20: mol_type = other DNA
ttatttactcattctacctt

SEQ ID NO: 3294 - DNA, 20 bp, synthetic construct
  source 1..20: mol_type = other DNA
acttggttatttactcattc

SEQ ID NO: 3295 - DNA, 20 bp, synthetic construct
  source 1..20: mol_type = other DNA
aatctccagttatgagtaag

SEQ ID NO: 3296 - DNA, 20 bp, synthetic construct
  source 1..20: mol_type = other DNA
atacttagcttttcaaatac

SEQ ID NO: 3297 - DNA, 20 bp, synthetic construct
  source 1..20: mol_type = other DNA
tgtcagcatacttagctttt

SEQ ID NO: 3298 - DNA, 20 bp, synthetic construct
  source 1..20: mol_type = other DNA
ccaggacagtgtcagcatac

SEQ ID NO: 3299 - DNA, 20 bp, synthetic construct
  source 1..20: mol_type = other DNA
ttttctgtacaaagttcagt

SEQ ID NO: 3300 - DNA, 20 bp, synthetic construct
  source 1..20: mol_type = other DNA
ttagttttgtttgggttttt

SEQ ID NO: 3301 - DNA, 20 bp, synthetic construct
  source 1..20: mol_type = other DNA
caactagttcttatcactat

SEQ ID NO: 3302 - DNA, 20 bp, synthetic construct
  source 1..20: mol_type = other DNA
caatgtcaactagttcttat

SEQ ID NO: 3303 - DNA, 20 bp, synthetic construct
  source 1..20: mol_type = other DNA
ttagttttccttcttgtctt

SEQ ID NO: 3304 - DNA, 20 bp, synthetic construct
  source 1..20: mol_type = other DNA
cctgggtttttagttttcct

SEQ ID NO: 3305 - DNA, 20 bp, synthetic construct
  source 1..20: mol_type = other DNA
attaggtcctgggtttttag

SEQ ID NO: 3306 - DNA, 20 bp, synthetic construct
  source 1..20: mol_type = other DNA
gcattaaatgactgtggtgc

SEQ ID NO: 3307 - DNA, 20 bp, synthetic construct
  source 1..20: mol_type = other DNA
gtgtttgcattaaatgactg

SEQ ID NO: 3308 - DNA, 20 bp, synthetic construct
  source 1..20: mol_type = other DNA
actaaatctgaccttcctca

SEQ ID NO: 3309 - DNA, 20 bp, synthetic construct
  source 1..20: mol_type = other DNA
tggtaagggccactaaatct

SEQ ID NO: 3310 - DNA, 20 bp, synthetic construct
  source 1..20: mol_type = other DNA
tgatatttctttttttttta

SEQ ID NO: 3311 - DNA, 20 bp, synthetic construct
  source 1..20: mol_type = other DNA
atgtgtttgatatttctttt

SEQ ID NO: 3312 - DNA, 20 bp, synthetic construct
  source 1..20: mol_type = other DNA
tgatctaaattgtgtctttt

SEQ ID NO: 3313 - DNA, 20 bp, synthetic construct
  source 1..20: mol_type = other DNA
gtattataacaatttgcata

SEQ ID NO: 3314 - DNA, 20 bp, synthetic construct
  source 1..20: mol_type = other DNA
cagggagtattataacaatt

SEQ ID NO: 3315 - DNA, 20 bp, synthetic construct
  source 1..20: mol_type = other DNA
tcatagaagcattctgtgtt

SEQ ID NO: 3316 - DNA, 20 bp, synthetic construct
  source 1..20: mol_type = other DNA
gtcattatctagtttctgga

SEQ ID NO: 3317 - DNA, 20 bp, synthetic construct
  source 1..20: mol_type = other DNA
caaatggtcattatctagtt

SEQ ID NO: 3318 - DNA, 20 bp, synthetic construct
  source 1..20: mol_type = other DNA
atctgctaggcatgcgggat

SEQ ID NO: 3319 - DNA, 20 bp, synthetic construct
  source 1..20: mol_type = other DNA
tgatttgtacacacccagca

SEQ ID NO: 3320 - DNA, 20 bp, synthetic construct
  source 1..20: mol_type = other DNA
gcactgatccaataaaaccc

SEQ ID NO: 3321 - DNA, 20 bp, synthetic construct
  source 1..20: mol_type = other DNA
cggctgctgttgctctggct

SEQ ID NO: 3322 - DNA, 20 bp, synthetic construct
  source 1..20: mol_type = other DNA
gtcttgcggctgctgttgct

SEQ ID NO: 3323 - DNA, 20 bp, synthetic construct
  source 1..20: mol_type = other DNA
ggtgacttgatgcacgatgc

SEQ ID NO: 3324 - DNA, 20 bp, synthetic construct
  source 1..20: mol_type = other DNA
ccaccctggtgacttgatgc

SEQ ID NO: 3325 - DNA, 20 bp, synthetic construct
  source 1..20: mol_type = other DNA
taagctatcagttccttgca

SEQ ID NO: 3326 - DNA, 20 bp, synthetic construct
  source 1..20: mol_type = other DNA
gaaccataagctatcagttc

SEQ ID NO: 3327 - DNA, 20 bp, synthetic construct
  source 1..20: mol_type = other DNA
ctttcatcacaatggagaac

SEQ ID NO: 3328 - DNA, 20 bp, synthetic construct
  source 1..20: mol_type = other DNA
taccatgtgctttcatcaca

SEQ ID NO: 3329 - DNA, 20 bp, synthetic construct
  source 1..20: mol_type = other DNA
aaaactgtaccatgtgcttt

SEQ ID NO: 3330 - DNA, 20 bp, synthetic construct
  source 1..20: mol_type = other DNA
tttgttcagtttagttgcag

SEQ ID NO: 3331 - DNA, 20 bp, synthetic construct
  source 1..20: mol_type = other DNA
tcaggtatttgttcagttta

SEQ ID NO: 3332 - DNA, 20 bp, synthetic construct
  source 1..20: mol_type = other DNA
aaagaaaagtcaggtatttg

SEQ ID NO: 3333 - DNA, 20 bp, synthetic construct
  source 1..20: mol_type = other DNA
gttggtttagtggatccagt

SEQ ID NO: 3334 - DNA, 20 bp, synthetic construct
  source 1..20: mol_type = other DNA
cttagtgttggtttagtgga

SEQ ID NO: 3335 - DNA, 20 bp, synthetic construct
  source 1..20: mol_type = other DNA
agattgttgttattgtatag

SEQ ID NO: 3336 - DNA, 20 bp, synthetic construct
  source 1..20: mol_type = other DNA
ttcttagagattgttgttat

SEQ ID NO: 3337 - DNA, 20 bp, synthetic construct
  source 1..20: mol_type = other DNA
ttatggaaattcttagagat

SEQ ID NO: 3338 - DNA, 20 bp, synthetic construct
  source 1..20: mol_type = other DNA
gtaatgatctgatattaaaa

SEQ ID NO: 3339 - DNA, 20 bp, synthetic construct
  source 1..20: mol_type = other DNA
tggtgggtaatgatctgata

SEQ ID NO: 3340 - DNA, 20 bp, synthetic construct
  source 1..20: mol_type = other DNA
gtttttgtgaggtaaaactg

SEQ ID NO: 3341 - DNA, 20 bp, synthetic construct
  source 1..20: mol_type = other DNA
tgtagtagtttttgtgaggt

SEQ ID NO: 3342 - DNA, 20 bp, synthetic construct
  source 1..20: mol_type = other DNA
cttggtgcttgtagtagttt

SEQ ID NO: 3343 - DNA, 20 bp, synthetic construct
  source 1..20: mol_type = other DNA
caccttttctatttgcacta

SEQ ID NO: 3344 - DNA, 20 bp, synthetic construct
  source 1..20: mol_type = other DNA
tcaaatgtcaccttttctat

SEQ ID NO: 3345 - DNA, 20 bp, synthetic construct
  source 1..20: mol_type = other DNA
atagcaagtcccctgaagct

SEQ ID NO: 3346 - DNA, 20 bp, synthetic construct
  source 1..20: mol_type = other DNA
tgatatgctatgctcacaga

SEQ ID NO: 3347 - DNA, 20 bp, synthetic construct
  source 1..20: mol_type = other DNA
ttagtttgatatgctatgct

SEQ ID NO: 3348 - DNA, 20 bp, synthetic construct
  source 1..20: mol_type = other DNA
cacagaacactttttccaga

SEQ ID NO: 3349 - DNA, 20 bp, synthetic construct
  source 1..20: mol_type = other DNA
atcacacagcagcatgttta

SEQ ID NO: 3350 - DNA, 20 bp, synthetic construct
  source 1..20: mol_type = other DNA
taatcatgttcccgatattg

SEQ ID NO: 3351 - DNA, 20 bp, synthetic construct
  source 1..20: mol_type = other DNA
ctaacatagttatatttaat

SEQ ID NO: 3352 - DNA, 20 bp, synthetic construct
  source 1..20: mol_type = other DNA
ggtttatatgtatacaattc

SEQ ID NO: 3353 - DNA, 20 bp, synthetic construct
  source 1..20: mol_type = other DNA
ttctcaggtttatatgtata

SEQ ID NO: 3354 - DNA, 20 bp, synthetic construct
  source 1..20: mol_type = other DNA
ttctttgttcataggagaac

SEQ ID NO: 3355 - DNA, 20 bp, synthetic construct
  source 1..20: mol_type = other DNA
gttcctttcttctttgttca

SEQ ID NO: 3356 - DNA, 20 bp, synthetic construct
  source 1..20: mol_type = other DNA
acctcttgttcctttcttct

SEQ ID NO: 3357 - DNA, 20 bp, synthetic construct
  source 1..20: mol_type = other DNA
gtttagatttatcctcagga

SEQ ID NO: 3358 - DNA, 20 bp, synthetic construct
  source 1..20: mol_type = other DNA
gggtttgtttagatttatcc

SEQ ID NO: 3359 - DNA, 20 bp, synthetic construct
  source 1..20: mol_type = other DNA
tgtaatactccatttttcct

SEQ ID NO: 3360 - DNA, 20 bp, synthetic construct
  source 1..20: mol_type = other DNA
caaatgtgtaatactccatt

SEQ ID NO: 3361 - DNA, 20 bp, synthetic construct
  source 1..20: mol_type = other DNA
ttagtcatttctctctggct

SEQ ID NO: 3362 - DNA, 20 bp, synthetic construct
  source 1..20: mol_type = other DNA
gtctatgttagtcatttctc

SEQ ID NO: 3363 - DNA, 20 bp, synthetic construct
  source 1..20: mol_type = other DNA
aaaaatcaagtctatgttag

SEQ ID NO: 3364 - DNA, 20 bp, synthetic construct
  source 1..20: mol_type = other DNA
atgtttaaggtattttcatg

SEQ ID NO: 3365 - DNA, 20 bp, synthetic construct
  source 1..20: mol_type = other DNA
acagttatgtttaaggtatt

SEQ ID NO: 3366 - DNA, 20 bp, synthetic construct
  source 1..20: mol_type = other DNA
aaaacagacttcgatttgga

SEQ ID NO: 3367 - DNA, 20 bp, synthetic construct
  source 1..20: mol_type = other DNA
gttatttactcattctacct

SEQ ID NO: 3368 - DNA, 20 bp, synthetic construct
  source 1..20: mol_type = other DNA
aacttggttatttactcatt

SEQ ID NO: 3369 - DNA, 20 bp, synthetic construct
  source 1..20: mol_type = other DNA
aagttggagaagtcaccagc

SEQ ID NO: 3370 - DNA, 20 bp, synthetic construct
  source 1..20: mol_type = other DNA
gcatacttagcttttcaaat

SEQ ID NO: 3371 - DNA, 20 bp, synthetic construct
  source 1..20: mol_type = other DNA
gtgtcagcatacttagcttt

SEQ ID NO: 3372 - DNA, 20 bp, synthetic construct
  source 1..20: mol_type = other DNA
tcttggaggtgacatttgtg

SEQ ID NO: 3373 - DNA, 20 bp, synthetic construct
  source 1..20: mol_type = other DNA
gtttttctgtacaaagttca

SEQ ID NO: 3374 - DNA, 20 bp, synthetic construct
  source 1..20: mol_type = other DNA
tgtttgggtttttctgtaca

SEQ ID NO: 3375 - DNA, 20 bp, synthetic construct
  source 1..20: mol_type = other DNA
ctttagttttgtttgggttt

SEQ ID NO: 3376 - DNA, 20 bp, synthetic construct
  source 1..20: mol_type = other DNA
tcaactagttcttatcacta

SEQ ID NO: 3377 - DNA, 20 bp, synthetic construct
  source 1..20: mol_type = other DNA
acaatgtcaactagttctta

SEQ ID NO: 3378 - DNA, 20 bp, synthetic construct
  source 1..20: mol_type = other DNA
ttttagttttccttcttgtc

SEQ ID NO: 3379 - DNA, 20 bp, synthetic construct
  source 1..20: mol_type = other DNA
agattaggtcctgggttttt

SEQ ID NO: 3380 - DNA, 20 bp, synthetic construct
  source 1..20: mol_type = other DNA
tgcattaaatgactgtggtg

SEQ ID NO: 3381 - DNA, 20 bp, synthetic construct
  source 1..20: mol_type = other DNA
agtgtttgcattaaatgact

SEQ ID NO: 3382 - DNA, 20 bp, synthetic construct
  source 1..20: mol_type = other DNA
ccactaaatctgaccttcct

SEQ ID NO: 3383 - DNA, 20 bp, synthetic construct
  source 1..20: mol_type = other DNA
tccattggtaagggccacta

SEQ ID NO: 3384 - DNA, 20 bp, synthetic construct
  source 1..20: mol_type = other DNA
tttgatatttcttttttttt

SEQ ID NO: 3385 - DNA, 20 bp, synthetic construct
  source 1..20: mol_type = other DNA
aatgtgtttgatatttcttt

SEQ ID NO: 3386 - DNA, 20 bp, synthetic construct
  source 1..20: mol_type = other DNA
cagttttgagatggtttgaa

SEQ ID NO: 3387 - DNA, 20 bp, synthetic construct
  source 1..20: mol_type = other DNA
agtattataacaatttgcat

SEQ ID NO: 3388 - DNA, 20 bp, synthetic construct
  source 1..20: mol_type = other DNA
ccagggagtattataacaat

SEQ ID NO: 3389 - DNA, 20 bp, synthetic construct
  source 1..20: mol_type = other DNA
ctagtttctggaaagtaatg

SEQ ID NO: 3390 - DNA, 20 bp, synthetic construct
  source 1..20: mol_type = other DNA
ggtcattatctagtttctgg

SEQ ID NO: 3391 - DNA, 20 bp, synthetic construct
  source 1..20: mol_type = other DNA
aacaaatggtcattatctag

SEQ ID NO: 3392 - DNA, 20 bp, synthetic construct
  source 1..20: mol_type = other DNA
ccaaattcctggttgctgtg

SEQ ID NO: 3393 - DNA, 20 bp, synthetic construct
  source 1..20: mol_type = other DNA
agggcctcttggattttgtt

SEQ ID NO: 3394 - DNA, 20 bp, synthetic construct
  source 1..20: mol_type = other DNA
gcggctgctgttgctctggc

SEQ ID NO: 3395 - DNA, 20 bp, synthetic construct
  source 1..20: mol_type = other DNA
tgtcttgcggctgctgttgc

SEQ ID NO: 3396 - DNA, 20 bp, synthetic construct
  source 1..20: mol_type = other DNA
gaccaccctggtgacttgat

SEQ ID NO: 3397 - DNA, 20 bp, synthetic construct
  source 1..20: mol_type = other DNA
ataagctatcagttccttgc

SEQ ID NO: 3398 - DNA, 20 bp, synthetic construct
  source 1..20: mol_type = other DNA
agaaccataagctatcagtt

SEQ ID NO: 3399 - DNA, 20 bp, synthetic construct
  source 1..20: mol_type = other DNA
tgctttcatcacaatggaga

SEQ ID NO: 3400 - DNA, 20 bp, synthetic construct
  source 1..20: mol_type = other DNA
ggaaaactgtaccatgtgct

SEQ ID NO: 3401 - DNA, 20 bp, synthetic construct
  source 1..20: mol_type = other DNA
tatttgttcagtttagttgc

SEQ ID NO: 3402 - DNA, 20 bp, synthetic construct
  source 1..20: mol_type = other DNA
gtcaggtatttgttcagttt

SEQ ID NO: 3403 - DNA, 20 bp, synthetic construct
  source 1..20: mol_type = other DNA
agtggatccagtcaattcaa

SEQ ID NO: 3404 - DNA, 20 bp, synthetic construct
  source 1..20: mol_type = other DNA
agagattgttgttattgtat

SEQ ID NO: 3405 - DNA, 20 bp, synthetic construct
  source 1..20: mol_type = other DNA
attcttagagattgttgtta

SEQ ID NO: 3406 - DNA, 20 bp, synthetic construct
  source 1..20: mol_type = other DNA
ctgatattaaaacatccagt

SEQ ID NO: 3407 - DNA, 20 bp, synthetic construct
  source 1..20: mol_type = other DNA
ggtaatgatctgatattaaa

SEQ ID NO: 3408 - DNA, 20 bp, synthetic construct
  source 1..20: mol_type = other DNA
tatggtgggtaatgatctga

SEQ ID NO: 3409 - DNA, 20 bp, synthetic construct
  source 1..20: mol_type = other DNA
tagtttttgtgaggtaaaac

SEQ ID NO: 3410 - DNA, 20 bp, synthetic construct
  source 1..20: mol_type = other DNA
ttgtagtagtttttgtgagg

SEQ ID NO: 3411 - DNA, 20 bp, synthetic construct
  source 1..20: mol_type = other DNA
ctatttgcactagctgccta

SEQ ID NO: 3412 - DNA, 20 bp, synthetic construct
  source 1..20: mol_type = other DNA
tcaccttttctatttgcact

SEQ ID NO: 3413 - DNA, 20 bp, synthetic construct
  source 1..20: mol_type = other DNA
tctcaaatgtcaccttttct

SEQ ID NO: 3414 - DNA, 20 bp, synthetic construct
  source 1..20: mol_type = other DNA
aaccatatgacatctcaaca

SEQ ID NO: 3415 - DNA, 20 bp, synthetic construct
  source 1..20: mol_type = other DNA
ttgatatgctatgctcacag

SEQ ID NO: 3416 - DNA, 20 bp, synthetic construct
  source 1..20: mol_type = other DNA
gttagtttgatatgctatgc

SEQ ID NO: 3417 - DNA, 20 bp, synthetic construct
  source 1..20: mol_type = other DNA
caactgaaaattctacacac

SEQ ID NO: 3418 - DNA, 20 bp, synthetic construct
  source 1..20: mol_type = other DNA
cagtagtctccccatagcca

SEQ ID NO: 3419 - DNA, 20 bp, synthetic construct
  source 1..20: mol_type = other DNA
tttaatcatgttcccgatat

SEQ ID NO: 3420 - DNA, 20 bp, synthetic construct
  source 1..20: mol_type = other DNA
agttatatttaatcatgttc

SEQ ID NO: 3421 - DNA, 20 bp, synthetic construct
  source 1..20: mol_type = other DNA
cactaacatagttatattta

SEQ ID NO: 3422 - DNA, 20 bp, synthetic construct
  source 1..20: mol_type = other DNA
aggtttatatgtatacaatt

SEQ ID NO: 3423 - DNA, 20 bp, synthetic construct
  source 1..20: mol_type = other DNA
gttctcaggtttatatgtat

SEQ ID NO: 3424 - DNA, 20 bp, synthetic construct
  source 1..20: mol_type = other DNA
tcttctttgttcataggaga

SEQ ID NO: 3425 - DNA, 20 bp, synthetic construct
  source 1..20: mol_type = other DNA
caacctcttgttcctttctt

SEQ ID NO: 3426 - DNA, 20 bp, synthetic construct
  source 1..20: mol_type = other DNA
tgtttagatttatcctcagg

SEQ ID NO: 3427 - DNA, 20 bp, synthetic construct
  source 1..20: mol_type = other DNA
tccatttttccttctagatt

SEQ ID NO: 3428 - DNA, 20 bp, synthetic construct
  source 1..20: mol_type = other DNA
gtgtaatactccatttttcc

SEQ ID NO: 3429 - DNA, 20 bp, synthetic construct
  source 1..20: mol_type = other DNA
tacaaatgtgtaatactcca

SEQ ID NO: 3430 - DNA, 20 bp, synthetic construct
  source 1..20: mol_type = other DNA
tgttagtcatttctctctgg

SEQ ID NO: 3431 - DNA, 20 bp, synthetic construct
  source 1..20: mol_type = other DNA
agtctatgttagtcatttct

SEQ ID NO: 3432 - DNA, 20 bp, synthetic construct
  source 1..20: mol_type = other DNA
gatgataaattaaggcagag

SEQ ID NO: 3433 - DNA, 20 bp, synthetic construct
  source 1..20: mol_type = other DNA
tatgtttaaggtattttcat

SEQ ID NO: 3434 - DNA, 20 bp, synthetic construct
  source 1..20: mol_type = other DNA
aacagttatgtttaaggtat

SEQ ID NO: 3435 - DNA, 20 bp, synthetic construct
  source 1..20: mol_type = other DNA
ctcattctaccttcaactct

SEQ ID NO: 3436 - DNA, 20 bp, synthetic construct
  source 1..20: mol_type = other DNA
ggttatttactcattctacc

SEQ ID NO: 3437 - DNA, 20 bp, synthetic construct
  source 1..20: mol_type = other DNA
taaacttggttatttactca

SEQ ID NO: 3438 - DNA, 20 bp, synthetic construct
  source 1..20: mol_type = other DNA
gagtgagcattagatggtca

SEQ ID NO: 3439 - DNA, 20 bp, synthetic construct
  source 1..20: mol_type = other DNA
agcatacttagcttttcaaa

SEQ ID NO: 3440 - DNA, 20 bp, synthetic construct
  source 1..20: mol_type = other DNA
agtgtcagcatacttagctt

SEQ ID NO: 3441 - DNA, 20 bp, synthetic construct
  source 1..20: mol_type = other DNA
agggaaatggtcattttcta

SEQ ID NO: 3442 - DNA, 20 bp, synthetic construct
  source 1..20: mol_type = other DNA
gggtttttctgtacaaagtt

SEQ ID NO: 3443 - DNA, 20 bp, synthetic construct
  source 1..20: mol_type = other DNA
ttgtttgggtttttctgtac

SEQ ID NO: 3444 - DNA, 20 bp, synthetic construct
  source 1..20: mol_type = other DNA
ttcttatcactattcagtca

SEQ ID NO: 3445 - DNA, 20 bp, synthetic construct
  source 1..20: mol_type = other DNA
gtcaactagttcttatcact

SEQ ID NO: 3446 - DNA, 20 bp, synthetic construct
  source 1..20: mol_type = other DNA
aaacaatgtcaactagttct

SEQ ID NO: 3447 - DNA, 20 bp, synthetic construct
  source 1..20: mol_type = other DNA
gtttttagttttccttcttg

SEQ ID NO: 3448 - DNA, 20 bp, synthetic construct
  source 1..20: mol_type = other DNA
gtcctgggtttttagttttc

SEQ ID NO: 3449 - DNA, 20 bp, synthetic construct
  source 1..20: mol_type = other DNA
gaagattaggtcctgggttt

SEQ ID NO: 3450 - DNA, 20 bp, synthetic construct
  source 1..20: mol_type = other DNA
ttgcattaaatgactgtggt

SEQ ID NO: 3451 - DNA, 20 bp, synthetic construct
  source 1..20: mol_type = other DNA
cagtgtttgcattaaatgac

SEQ ID NO: 3452 - DNA, 20 bp, synthetic construct
  source 1..20: mol_type = other DNA
ggccactaaatctgaccttc

SEQ ID NO: 3453 - DNA, 20 bp, synthetic construct
  source 1..20: mol_type = other DNA
aatccattggtaagggccac

SEQ ID NO: 3454 - DNA, 20 bp, synthetic construct
  source 1..20: mol_type = other DNA
gtttgatatttctttttttt

SEQ ID NO: 3455 - DNA, 20 bp, synthetic construct
  source 1..20: mol_type = other DNA
caaatgtgtttgatatttct

SEQ ID NO: 3456 - DNA, 20 bp, synthetic construct
  source 1..20: mol_type = other DNA
aacaatttgcatagtctctc

SEQ ID NO: 3457 - DNA, 20 bp, synthetic construct
  source 1..20: mol_type = other DNA
gagtattataacaatttgca

SEQ ID NO: 3458 - DNA, 20 bp, synthetic construct
  source 1..20: mol_type = other DNA
ttccagggagtattataaca

SEQ ID NO: 3459 - DNA, 20 bp, synthetic construct
  source 1..20: mol_type = other DNA
atctagtttctggaaagtaa

SEQ ID NO: 3460 - DNA, 20 bp, synthetic construct
  source 1..20: mol_type = other DNA
ataacaaatggtcattatct

SEQ ID NO: 3461 - DNA, 20 bp, synthetic construct
  source 1..20: mol_type = other DNA
aatccaaatcttgtattctt

SEQ ID NO: 3462 - DNA, 20 bp, synthetic construct
  source 1..20: mol_type = other DNA
tctagaaatgattttgatta

SEQ ID NO: 3463 - DNA, 20 bp, synthetic construct
  source 1..20: mol_type = other DNA
tgggcatttaagaaatgctc

SEQ ID NO: 3464 - DNA, 20 bp, synthetic construct
  source 1..20: mol_type = other DNA
tgcggctgctgttgctctgg

SEQ ID NO: 3465 - DNA, 20 bp, synthetic construct
  source 1..20: mol_type = other DNA
atgtcttgcggctgctgttg

SEQ ID NO: 3466 - DNA, 20 bp, synthetic construct
  source 1..20: mol_type = other DNA
ctggtgacttgatgcacgat

SEQ ID NO: 3467 - DNA, 20 bp, synthetic construct
  source 1..20: mol_type = other DNA
tggaccaccctggtgacttg

SEQ ID NO: 3468 - DNA, 20 bp, synthetic construct
  source 1..20: mol_type = other DNA
cataagctatcagttccttg

SEQ ID NO: 3469 - DNA, 20 bp, synthetic construct
  source 1..20: mol_type = other DNA
gagaaccataagctatcagt

SEQ ID NO: 3470 - DNA, 20 bp, synthetic construct
  source 1..20: mol_type = other DNA
tgtgctttcatcacaatgga

SEQ ID NO: 3471 - DNA, 20 bp, synthetic construct
  source 1..20: mol_type = other DNA
tgtaccatgtgctttcatca

SEQ ID NO: 3472 - DNA, 20 bp, synthetic construct
  source 1..20: mol_type = other DNA
ttggaaaactgtaccatgtg

SEQ ID NO: 3473 - DNA, 20 bp, synthetic construct
  source 1..20: mol_type = other DNA
ttagtggatccagtcaattc

SEQ ID NO: 3474 - DNA, 20 bp, synthetic construct
  source 1..20: mol_type = other DNA
ccatcttagtgttggtttag

SEQ ID NO: 3475 - DNA, 20 bp, synthetic construct
  source 1..20: mol_type = other DNA
tagagattgttgttattgta

SEQ ID NO: 3476 - DNA, 20 bp, synthetic construct
  source 1..20: mol_type = other DNA
aattcttagagattgttgtt

SEQ ID NO: 3477 - DNA, 20 bp, synthetic construct
  source 1..20: mol_type = other DNA
catatggtgggtaatgatct

SEQ ID NO: 3478 - DNA, 20 bp, synthetic construct
  source 1..20: mol_type = other DNA
gtagtttttgtgaggtaaaa

SEQ ID NO: 3479 - DNA, 20 bp, synthetic construct
  source 1..20: mol_type = other DNA
ttctatttgcactagctgcc

SEQ ID NO: 3480 - DNA, 20 bp, synthetic construct
  source 1..20: mol_type = other DNA
tgtcaccttttctatttgca

SEQ ID NO: 3481 - DNA, 20 bp, synthetic construct
  source 1..20: mol_type = other DNA
cctctcaaatgtcacctttt

SEQ ID NO: 3482 - DNA, 20 bp, synthetic construct
  source 1..20: mol_type = other DNA
ctatgctcacagagaacctg

SEQ ID NO: 3483 - DNA, 20 bp, synthetic construct
  source 1..20: mol_type = other DNA
tttgatatgctatgctcaca

SEQ ID NO: 3484 - DNA, 20 bp, synthetic construct
  source 1..20: mol_type = other DNA
cagttagtttgatatgctat

SEQ ID NO: 3485 - DNA, 20 bp, synthetic construct
  source 1..20: mol_type = other DNA
tgtgatttatcgctgacctt

SEQ ID NO: 3486 - DNA, 20 bp, synthetic construct
  source 1..20: mol_type = other DNA
gaatggttctcttttacggg

SEQ ID NO: 3487 - DNA, 20 bp, synthetic construct
  source 1..20: mol_type = other DNA
tatttaatcatgttcccgat

SEQ ID NO: 3488 - DNA, 20 bp, synthetic construct
  source 1..20: mol_type = other DNA
tagttatatttaatcatgtt

SEQ ID NO: 3489 - DNA, 20 bp, synthetic construct
  source 1..20: mol_type = other DNA
atgtatacaattctgacagt

SEQ ID NO: 3490 - DNA, 20 bp, synthetic construct
  source 1..20: mol_type = other DNA
caggtttatatgtatacaat

SEQ ID NO: 3491 - DNA, 20 bp, synthetic construct
  source 1..20: mol_type = other DNA
atgttctcaggtttatatgt

SEQ ID NO: 3492 - DNA, 20 bp, synthetic construct
  source 1..20: mol_type = other DNA
tttcttctttgttcatagga

SEQ ID NO: 3493 - DNA, 20 bp, synthetic construct
  source 1..20: mol_type = other DNA
ttgttcctttcttctttgtt

SEQ ID NO: 3494 - DNA, 20 bp, synthetic construct
  source 1..20: mol_type = other DNA
aacaacctcttgttcctttc

SEQ ID NO: 3495 - DNA, 20 bp, synthetic construct
  source 1..20: mol_type = other DNA
ttgtttagatttatcctcag

SEQ ID NO: 3496 - DNA, 20 bp, synthetic construct
  source 1..20: mol_type = other DNA
actccatttttccttctaga

SEQ ID NO: 3497 - DNA, 20 bp, synthetic construct
  source 1..20: mol_type = other DNA
attacaaatgtgtaatactc

SEQ ID NO: 3498 - DNA, 20 bp, synthetic construct
  source 1..20: mol_type = other DNA
atgttagtcatttctctctg

SEQ ID NO: 3499 - DNA, 20 bp, synthetic construct
  source 1..20: mol_type = other DNA
aagtctatgttagtcatttc

SEQ ID NO: 3500 - DNA, 20 bp, synthetic construct
  source 1..20: mol_type = other DNA
aggtattttcatggagtttc

SEQ ID NO: 3501 - DNA, 20 bp, synthetic construct
  source 1..20: mol_type = other DNA
ttatgtttaaggtattttca

SEQ ID NO: 3502 - DNA, 20 bp, synthetic construct
  source 1..20: mol_type = other DNA
gtaacagttatgtttaaggt

SEQ ID NO: 3503 - DNA, 20 bp, synthetic construct
  source 1..20: mol_type = other DNA
tactcattctaccttcaact

SEQ ID NO: 3504 - DNA, 20 bp, synthetic construct
  source 1..20: mol_type = other DNA
cataaacttggttatttact

SEQ ID NO: 3505 - DNA, 20 bp, synthetic construct
  source 1..20: mol_type = other DNA
ccactaccacccccaaacca

SEQ ID NO: 3506 - DNA, 20 bp, synthetic construct
  source 1..20: mol_type = other DNA
cagcatacttagcttttcaa

SEQ ID NO: 3507 - DNA, 20 bp, synthetic construct
  source 1..20: mol_type = other DNA
cagtgtcagcatacttagct

SEQ ID NO: 3508 - DNA, 20 bp, synthetic construct
  source 1..20: mol_type = other DNA
catgtattgctaggagccag

SEQ ID NO: 3509 - DNA, 20 bp, synthetic construct
  source 1..20: mol_type = other DNA
tgggtttttctgtacaaagt

SEQ ID NO: 3510 - DNA, 20 bp, synthetic construct
  source 1..20: mol_type = other DNA
tttgtttgggtttttctgta

SEQ ID NO: 3511 - DNA, 20 bp, synthetic construct
  source 1..20: mol_type = other DNA
agttcttatcactattcagt

SEQ ID NO: 3512 - DNA, 20 bp, synthetic construct
  source 1..20: mol_type = other DNA
ctaaacaatgtcaactagtt

SEQ ID NO: 3513 - DNA, 20 bp, synthetic construct
  source 1..20: mol_type = other DNA
gggtttttagttttccttct

SEQ ID NO: 3514 - DNA, 20 bp, synthetic construct
  source 1..20: mol_type = other DNA
ggtcctgggtttttagtttt

SEQ ID NO: 3515 - DNA, 20 bp, synthetic construct
  source 1..20: mol_type = other DNA
aatgactgtggtgcagcctc

SEQ ID NO: 3516 - DNA, 20 bp, synthetic construct
  source 1..20: mol_type = other DNA
tttgcattaaatgactgtgg

SEQ ID NO: 3517 - DNA, 20 bp, synthetic construct
  source 1..20: mol_type = other DNA
gccagtgtttgcattaaatg

SEQ ID NO: 3518 - DNA, 20 bp, synthetic construct
  source 1..20: mol_type = other DNA
agggccactaaatctgacct

SEQ ID NO: 3519 - DNA, 20 bp, synthetic construct
  source 1..20: mol_type = other DNA
agaatccattggtaagggcc

SEQ ID NO: 3520 - DNA, 20 bp, synthetic construct
  source 1..20: mol_type = other DNA
ttcaaatgtgtttgatattt

SEQ ID NO: 3521 - DNA, 20 bp, synthetic construct
  source 1..20: mol_type = other DNA
ataacaatttgcatagtctc

SEQ ID NO: 3522 - DNA, 20 bp, synthetic construct
  source 1..20: mol_type = other DNA
ttttccagggagtattataa

SEQ ID NO: 3523 - DNA, 20 bp, synthetic construct
  source 1..20: mol_type = other DNA
ttatctagtttctggaaagt

SEQ ID NO: 3524 - DNA, 20 bp, synthetic construct
  source 1..20: mol_type = other DNA
atggtcattatctagtttct

SEQ ID NO: 3525 - DNA, 20 bp, synthetic construct
  source 1..20: mol_type = other DNA
tgataacaaatggtcattat

SEQ ID NO: 3526 - DNA, 20 bp, synthetic construct
  source 1..20: mol_type = other DNA
catcaaaattgtgcacaatt

SEQ ID NO: 3527 - DNA, 20 bp, synthetic construct
  source 1..20: mol_type = other DNA
tgaaaacatgttgtgtgatt

SEQ ID NO: 3528 - DNA, 20 bp, synthetic construct
  source 1..20: mol_type = other DNA
ttgttggattctttttttct

SEQ ID NO: 3529 - DNA, 20 bp, synthetic construct
  source 1..20: mol_type = other DNA
gacttgatgcacgatgctct

SEQ ID NO: 3530 - DNA, 20 bp, synthetic construct
  source 1..20: mol_type = other DNA
atgcacgatgctctgtaaag

SEQ ID NO: 3531 - DNA, 20 bp, synthetic construct
  source 1..20: mol_type = other DNA
tgatgcacgatgctctgtaa

SEQ ID NO: 3532 - DNA, 20 bp, synthetic construct
  source 1..20: mol_type = other DNA
cttgatgcacgatgctctgt

SEQ ID NO: 3533 - DNA, 20 bp, synthetic construct
  source 1..20: mol_type = other DNA
tgattgtgttccattgtaaa

SEQ ID NO: 3534 - DNA, 20 bp, synthetic construct
  source 1..20: mol_type = other DNA
gagttgtccatagtcatgaa

SEQ ID NO: 3535 - DNA, 20 bp, synthetic construct
  source 1..20: mol_type = other DNA
cgagttgtccatagtcatga

SEQ ID NO: 3536 - DNA, 20 bp, synthetic construct
  source 1..20: mol_type = other DNA
tgcacttttgtttctacagc

SEQ ID NO: 3537 - DNA, 20 bp, synthetic construct
  source 1..20: mol_type = other DNA
aggccttgcacttttgtttc

SEQ ID NO: 3538 - DNA, 20 bp, synthetic construct
  source 1..20: mol_type = other DNA
aagtggcacccgagttgtcc

SEQ ID NO: 3539 - DNA, 20 bp, synthetic construct
  source 1..20: mol_type = other DNA
gccttgcacttttgtttcta

SEQ ID NO: 3540 - DNA, 20 bp, synthetic construct
  source 1..20: mol_type = other DNA
gattgtgttccattgtaaac

SEQ ID NO: 3541 - DNA, 20 bp, synthetic construct
  source 1..20: mol_type = other DNA
gtggatccagtcaattcaat

SEQ ID NO: 3542 - DNA, 20 bp, synthetic construct
  source 1..20: mol_type = other DNA
aatagcagctatttcatgac

SEQ ID NO: 3543 - DNA, 20 bp, synthetic construct
  source 1..20: mol_type = other DNA
tggatccagtcaattcaata

SEQ ID NO: 3544 - DNA, 20 bp, synthetic construct
  source 1..20: mol_type = other DNA
tcaattcaatactcgaagta

SEQ ID NO: 3545 - DNA, 20 bp, synthetic construct
  source 1..20: mol_type = other DNA
ggatccagtcaattcaatac

SEQ ID NO: 3546 - DNA, 20 bp, synthetic construct
  source 1..20: mol_type = other DNA
caatgactcttcactcatgt

SEQ ID NO: 3547 - DNA, 20 bp, synthetic construct
  source 1..20: mol_type = other DNA
actattttcaactcaagctg

SEQ ID NO: 3548 - DNA, 20 bp, synthetic construct
  source 1..20: mol_type = other DNA
gactcttcactcatgtttat

SEQ ID NO: 3549 - DNA, 20 bp, synthetic construct
  source 1..20: mol_type = other DNA
ggtactggctcatcagttgt

SEQ ID NO: 3550 - DNA, 20 bp, synthetic construct
  source 1..20: mol_type = other DNA
aatgactcttcactcatgtt

SEQ ID NO: 3551 - DNA, 20 bp, synthetic construct
  source 1..20: mol_type = other DNA
agcaatgactcttcactcat

SEQ ID NO: 3552 - DNA, 20 bp, synthetic construct
  source 1..20: mol_type = other DNA
aagcaatgactcttcactca

SEQ ID NO: 3553 - DNA, 20 bp, synthetic construct
  source 1..20: mol_type = other DNA
aaccaatctatcacaccaat

SEQ ID NO: 3554 - DNA, 20 bp, synthetic construct
  source 1..20: mol_type = other DNA
agccatccaagtaagaatat

SEQ ID NO: 3555 - DNA, 20 bp, synthetic construct
  source 1..20: mol_type = other DNA
accaatctatcacaccaatg

SEQ ID NO: 3556 - DNA, 20 bp, synthetic construct
  source 1..20: mol_type = other DNA
caatctatcacaccaatgca

SEQ ID NO: 3557 - DNA, 20 bp, synthetic construct
  source 1..20: mol_type = other DNA
cagccatccaagtaagaata

SEQ ID NO: 3558 - DNA, 20 bp, synthetic construct
  source 1..20: mol_type = other DNA
tattgtcacatactagttca

SEQ ID NO: 3559 - DNA, 20 bp, synthetic construct
  source 1..20: mol_type = other DNA
ctgactaatttcttggtgat

SEQ ID NO: 3560 - DNA, 20 bp, synthetic construct
  source 1..20: mol_type = other DNA
gtggtcatttattgtcacat

SEQ ID NO: 3561 - DNA, 20 bp, synthetic construct
  source 1..20: mol_type = other DNA
gtcacatactagttcataat

SEQ ID NO: 3562 - DNA, 20 bp, synthetic construct
  source 1..20: mol_type = other DNA
ttattgtcacatactagttc

SEQ ID NO: 3563 - DNA, 20 bp, synthetic construct
  source 1..20: mol_type = other DNA
cccgagttgtccatagtcat

SEQ ID NO: 3564 - DNA, 20 bp, synthetic construct
  source 1..20: mol_type = other DNA
cattgtaaacgcaaaaggcc

SEQ ID NO: 3565 - DNA, 20 bp, synthetic construct
  source 1..20: mol_type = other DNA
cagtcaattcaatactcgaa

SEQ ID NO: 3566 - DNA, 20 bp, synthetic construct
  source 1..20: mol_type = other DNA
gtccatagtcatgaactata

SEQ ID NO: 3567 - DNA, 20 bp, synthetic construct
  source 1..20: mol_type = other DNA
atagcagctatttcatgact

SEQ ID NO: 3568 - DNA, 20 bp, synthetic construct
  source 1..20: mol_type = other DNA
gtcaattcaatactcgaagt

SEQ ID NO: 3569 - DNA, 20 bp, synthetic construct
  source 1..20: mol_type = other DNA
gatccagtcaattcaatact

SEQ ID NO: 3570 - DNA, 20 bp, synthetic construct
  source 1..20: mol_type = other DNA
taaccaatctatcacaccaa

SEQ ID NO: 3571 - DNA, 20 bp, synthetic construct
  source 1..20: mol_type = other DNA
atgactcttcactcatgttt

SEQ ID NO: 3572 - DNA, 20 bp, synthetic construct
  source 1..20: mol_type = other DNA
gactattttcaactcaagct

SEQ ID NO: 3573 - DNA, 20 bp, synthetic construct
  source 1..20: mol_type = other DNA
cttggtggtcatttattgtc

SEQ ID NO: 3574 - DNA, 20 bp, synthetic construct
  source 1..20: mol_type = other DNA
ggtggtcatttattgtcaca

SEQ ID NO: 3575 - DNA, 20 bp, synthetic construct
  source 1..20: mol_type = other DNA
tagttgcagccatccaagta

SEQ ID NO: 3576 - DNA, 20 bp, synthetic construct
  source 1..20: mol_type = other DNA
tggtggtcatttattgtcac

SEQ ID NO: 3577 - DNA, 20 bp, synthetic construct
  source 1..20: mol_type = other DNA
gttcagtttagttgcagcca

SEQ ID NO: 3578 - DNA, 20 bp, synthetic construct
  source 1..20: mol_type = other DNA
catactagttcataattcac

SEQ ID NO: 3579 - DNA, 20 bp, synthetic construct
  source 1..20: mol_type = other DNA
tcgccctgactaatttcttg

SEQ ID NO: 3580 - DNA, 20 bp, synthetic construct
  source 1..20: mol_type = other DNA
ccctgactaatttcttggtg

SEQ ID NO: 3581 - DNA, 20 bp, synthetic construct
  source 1..20: mol_type = other DNA
gccctgactaatttcttggt

SEQ ID NO: 3582 - DNA, 20 bp, synthetic construct
  source 1..20: mol_type = other DNA
cgtgggtgttcgctctctcc

SEQ ID NO: 3583 - DNA, 20 bp, synthetic construct
  source 1..20: mol_type = other DNA
gcgtgggtgttcgctctctc

SEQ ID NO: 3584 - DNA, 20 bp, synthetic construct
  source 1..20: mol_type = other DNA
ctcttaccatcaaaggctaa

SEQ ID NO: 3585 - DNA, 20 bp, synthetic construct
  source 1..20: mol_type = other DNA
tgtggcagcccgtattcctc

SEQ ID NO: 3586 - DNA, 20 bp, synthetic construct
  source 1..20: mol_type = other DNA
gggtgttcgctctctccctc

SEQ ID NO: 3587 - DNA, 20 bp, synthetic construct
  source 1..20: mol_type = other DNA
gtgggtgttcgctctctccc

SEQ ID NO: 3588 - DNA, 20 bp, synthetic construct
  source 1..20: mol_type = other DNA
ccgtattcctcttaccatca

SEQ ID NO: 3589 - DNA, 20 bp, synthetic construct
  source 1..20: mol_type = other DNA
gtattcctcttaccatcaaa

SEQ ID NO: 3590 - DNA, 20 bp, synthetic construct
  source 1..20: mol_type = other DNA
cccgtattcctcttaccatc

SEQ ID NO: 3591 - DNA, 20 bp, synthetic construct
  source 1..20: mol_type = other DNA
ttttcttttcgccctgacta

SEQ ID NO: 3592 - DNA, 20 bp, synthetic construct
  source 1..20: mol_type = other DNA
tcatttattgtcacatacta

SEQ ID NO: 3593 - DNA, 20 bp, synthetic construct
  source 1..20: mol_type = other DNA
cacccgagttgtccatagtc

SEQ ID NO: 3594 - DNA, 20 bp, synthetic construct
  source 1..20: mol_type = other DNA
gtcatttattgtcacatact

SEQ ID NO: 3595 - DNA, 20 bp, synthetic construct
  source 1..20: mol_type = other DNA
ttttttcttttcgccctgac

SEQ ID NO: 3596 - DNA, 20 bp, synthetic construct
  source 1..20: mol_type = other DNA
gttgtccatagtcatgaact

SEQ ID NO: 3597 - DNA, 20 bp, synthetic construct
  source 1..20: mol_type = other DNA
taattcacattcatcccttt

SEQ ID NO: 3598 - DNA, 20 bp, synthetic construct
  source 1..20: mol_type = other DNA
tcctaacactgcacagaaac

SEQ ID NO: 3599 - DNA, 20 bp, synthetic construct
  source 1..20: mol_type = other DNA
tccatagtcatgaactataa

SEQ ID NO: 3600 - DNA, 20 bp, synthetic construct
  source 1..20: mol_type = other DNA
ccatagtcatgaactataaa

SEQ ID NO: 3601 - DNA, 20 bp, synthetic construct
  source 1..20: mol_type = other DNA
catagtcatgaactataaac

SEQ ID NO: 3602 - DNA, 20 bp, synthetic construct
  source 1..20: mol_type = other DNA
acagaaaccagcgtgggtgt

SEQ ID NO: 3603 - DNA, 20 bp, synthetic construct
  source 1..20: mol_type = other DNA
ctgcacagaaaccagcgtgg

SEQ ID NO: 3604 - DNA, 20 bp, synthetic construct
  source 1..20: mol_type = other DNA
cataattcacattcatccct

SEQ ID NO: 3605 - DNA, 20 bp, synthetic construct
  source 1..20: mol_type = other DNA
gcacccgagttgtccatagt

SEQ ID NO: 3606 - DNA, 20 bp, synthetic construct
  source 1..20: mol_type = other DNA
tttttcttttcgccctgact

SEQ ID NO: 3607 - DNA, 20 bp, synthetic construct
  source 1..20: mol_type = other DNA
actgcacagaaaccagcgtg

SEQ ID NO: 3608 - DNA, 20 bp, synthetic construct
  source 1..20: mol_type = other DNA
tgtgttccattgtaaacgca

SEQ ID NO: 3609 - DNA, 20 bp, synthetic construct
  source 1..20: mol_type = other DNA
cctaacactgcacagaaacc

SEQ ID NO: 3610 - DNA, 20 bp, synthetic construct
  source 1..20: mol_type = other DNA
ttttatcccagtcattggcc

SEQ ID NO: 3611 - DNA, 20 bp, synthetic construct
  source 1..20: mol_type = other DNA
ccagtcattggcccccaaac

SEQ ID NO: 3612 - DNA, 20 bp, synthetic construct
  source 1..20: mol_type = other DNA
ttttctgtgcctcctgacct

SEQ ID NO: 3613 - DNA, 20 bp, synthetic construct
  source 1..20: mol_type = other DNA
gacctctacccttgtgagca

SEQ ID NO: 3614 - DNA, 20 bp, synthetic construct
  source 1..20: mol_type = other DNA
cactgcacagaaaccagcgt

SEQ ID NO: 3615 - DNA, 20 bp, synthetic construct
  source 1..20: mol_type = other DNA
ttaatgagaacaaagtctat

SEQ ID NO: 3616 - DNA, 20 bp, synthetic construct
  source 1..20: mol_type = other DNA
catccaagtaagaatattta

SEQ ID NO: 3617 - DNA, 20 bp, synthetic construct
  source 1..20: mol_type = other DNA
aacactgcacagaaaccagc

SEQ ID NO: 3618 - DNA, 20 bp, synthetic construct
  source 1..20: mol_type = other DNA
aatgagaacaaagtctatgt

SEQ ID NO: 3619 - DNA, 20 bp, synthetic construct
  source 1..20: mol_type = other DNA
gccatccaagtaagaatatt

SEQ ID NO: 3620 - DNA, 20 bp, synthetic construct
  source 1..20: mol_type = other DNA
gttgcagccatccaagtaag

SEQ ID NO: 3621 - DNA, 20 bp, synthetic construct
  source 1..20: mol_type = other DNA
ccgagttgtccatagtcatg

SEQ ID NO: 3622 - DNA, 20 bp, synthetic construct
  source 1..20: mol_type = other DNA
caaagtctatgtggcagccc

SEQ ID NO: 3623 - DNA, 20 bp, synthetic construct
  source 1..20: mol_type = other DNA
taacactgcacagaaaccag

SEQ ID NO: 3624 - DNA, 20 bp, synthetic construct
  source 1..20: mol_type = other DNA
cagtttagttgcagccatcc

SEQ ID NO: 3625 - DNA, 17 bp, synthetic construct
  source 1..17: mol_type = other DNA
cacgcttttattttctg

SEQ ID NO: 3626 - DNA, 17 bp, synthetic construct
  source 1..17: mol_type = other DNA
ccacgcttttattttct

SEQ ID NO: 3627 - DNA, 17 bp, synthetic construct
  source 1..17: mol_type = other DNA
tttataacttttctttc

SEQ ID NO: 3628 - DNA, 17 bp, synthetic construct
  source 1..17: mol_type = other DNA
ctttataacttttcttt

SEQ ID NO: 3629 - DNA, 17 bp, synthetic construct
  source 1..17: mol_type = other DNA
cctttataacttttctt

SEQ ID NO: 3630 - DNA, 17 bp, synthetic construct
  source 1..17: mol_type = other DNA
gcctttataacttttct

SEQ ID NO: 3631 - DNA, 17 bp, synthetic construct
  source 1..17: mol_type = other DNA
tcatttattgtcacata

SEQ ID NO: 3632 - DNA, 17 bp, synthetic construct
  source 1..17: mol_type = other DNA
catttattgtcacatac

SEQ ID NO: 3633 - DNA, 17 bp, synthetic construct
  source 1..17: mol_type = other DNA
gtcatttattgtcacat

SEQ ID NO: 3634 - DNA, 17 bp, synthetic construct
  source 1..17: mol_type = other DNA
ggtcatttattgtcaca

SEQ ID NO: 3635 - DNA, 17 bp, synthetic construct
  source 1..17: mol_type = other DNA
ccgagttgtccatagtc

SEQ ID NO: 3636 - DNA, 17 bp, synthetic construct
  source 1..17: mol_type = other DNA
cccgagttgtccatagt

SEQ ID NO: 3637 - DNA, 17 bp, synthetic construct
  source 1..17: mol_type = other DNA
acccgagttgtccatag

SEQ ID NO: 3638 - DNA, 17 bp, synthetic construct
  source 1..17: mol_type = other DNA
tcagtttagttgcagcc

SEQ ID NO: 3639 - DNA, 17 bp, synthetic construct
  source 1..17: mol_type = other DNA
cagtttagttgcagcca

SEQ ID NO: 3640 - DNA, 17 bp, synthetic construct
  source 1..17: mol_type = other DNA
ttcagtttagttgcagc

SEQ ID NO: 3641 - DNA, 17 bp, synthetic construct
  source 1..17: mol_type = other DNA
ttcttttttctgtgcct

SEQ ID NO: 3642 - DNA, 17 bp, synthetic construct
  source 1..17: mol_type = other DNA
  modified_base 7: mod_base = OTHER; note = uracil
cgcttttattttctgat

SEQ ID NO: 3643 - DNA, 17 bp, synthetic construct
  source 1..17: mol_type = other DNA
  modified_base 7: mod_base = OTHER; note = uracil
ccacgcttttattttct

SEQ ID NO: 3644 - DNA, 17 bp, synthetic construct
  source 1..17: mol_type = other DNA
  modified_base 7: mod_base = OTHER; note = uracil
cctttataacttttctt

SEQ ID NO: 3645 - DNA, 17 bp, synthetic construct
  source 1..17: mol_type = other DNA
  modified_base 7: mod_base = OTHER; note = uracil
catttattgtcacatac

SEQ ID NO: 3646 - DNA, 17 bp, synthetic construct
  source 1..17: mol_type = other DNA
  modified_base 7: mod_base = OTHER; note = uracil
gtcatttattgtcacat

SEQ ID NO: 3647 - DNA, 17 bp, synthetic construct
  source 1..17: mol_type = other DNA
  modified_base 7: mod_base = OTHER; note = uracil
ggtcatttattgtcaca

SEQ ID NO: 3648 - DNA, 17 bp, synthetic construct
  source 1..17: mol_type = other DNA
  modified_base 7: mod_base = OTHER; note = uracil
ccgagttgtccatagtc

SEQ ID NO: 3649 - DNA, 17 bp, synthetic construct
  source 1..17: mol_type = other DNA
cgagttgtccatagtca

SEQ ID NO: 3650 - DNA, 17 bp, synthetic construct
  source 1..17: mol_type = other DNA
  modified_base 7: mod_base = OTHER; note = uracil
tttcttttttctgtgcc

SEQ ID NO: 3651 - DNA, 17 bp, synthetic construct
  source 1..17: mol_type = other DNA
  modified_base 7: mod_base = OTHER; note = uracil
ttcttttttctgtgcct

SEQ ID NO: 3652 - DNA, 17 bp, synthetic construct
  source 1..17: mol_type = other DNA
  modified_base 7: mod_base = OTHER; note = uracil
cccgagttgtccatagt

SEQ ID NO: 3653 - DNA, 17 bp, synthetic construct
  source 1..17: mol_type = other DNA
  modified_base 7: mod_base = OTHER; note = uracil
ttcagtttagttgcagc

SEQ ID NO: 3654 - DNA, 17 bp, synthetic construct
  source 1..17: mol_type = other DNA
  modified_base 7: mod_base = OTHER; note = uracil
tcagtttagttgcagcc

SEQ ID NO: 3655 - DNA, 20 bp, synthetic construct
  source 1..20: mol_type = other DNA
ttgttcagtttagttgcagc

SEQ ID NO: 3656 - DNA, 17 bp, synthetic construct
  source 1..17: mol_type = other DNA
gcacccgagttgtccat

SEQ ID NO: 3657 - DNA, 17 bp, synthetic construct
  source 1..17: mol_type = other DNA
cagcccgtattcctctt

SEQ ID NO: 3658 - DNA, 17 bp, synthetic construct
  source 1..17: mol_type = other DNA
cacccgagttgtccata

SEQ ID NO: 3659 - DNA, 17 bp, synthetic construct
  source 1..17: mol_type = other DNA
gagttgtccatagtcat

SEQ ID NO: 3660 - DNA, 17 bp, synthetic construct
  source 1..17: mol_type = other DNA
cccgtattcctcttacc

SEQ ID NO: 3661 - DNA, 17 bp, synthetic construct
  source 1..17: mol_type = other DNA
agcccgtattcctctta

SEQ ID NO: 3662 - DNA, 17 bp, synthetic construct
  source 1..17: mol_type = other DNA
agtttagttgcagccat

SEQ ID NO: 3663 - DNA, 17 bp, synthetic construct
  source 1..17: mol_type = other DNA
gtattcctcttaccatc

SEQ ID NO: 3664 - DNA, 17 bp, synthetic construct
  source 1..17: mol_type = other DNA
cgtattcctcttaccat

SEQ ID NO: 3665 - DNA, 17 bp, synthetic construct
  source 1..17: mol_type = other DNA
tgttcagtttagttgca

SEQ ID NO: 3666 - DNA, 17 bp, synthetic construct
  source 1..17: mol_type = other DNA
tattcctcttaccatca

SEQ ID NO: 3667 - DNA, 17 bp, synthetic construct
  source 1..17: mol_type = other DNA
ccgtattcctcttacca

SEQ ID NO: 3668 - DNA, 17 bp, synthetic construct
  source 1..17: mol_type = other DNA
gcccgtattcctcttac

SEQ ID NO: 3669 - DNA, 17 bp, synthetic construct
  source 1..17: mol_type = other DNA
ttgttcagtttagttgc

SEQ ID NO: 3670 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2..3: mod_base = OTHER; note = 2'-MOE 5-methyl cytidine 3'-phosphodiester
  modified_base 4: mod_base = OTHER; note = 2'-MOE guanosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7..8: mod_base = OTHER; note = 2'-deoxythymidine 3'-phosphorothioate
  modified_base 9..10: mod_base = OTHER; note = 5-methyl 2'-deoxycytidine 3'-phosphorothioate
  modified_base 11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13..14: mod_base = OTHER; note = 2'-deoxythymidine 3'-phosphorothioate
  modified_base 15: mod_base = OTHER; note = 2'-deoxyadenosine 3'-phosphorothioate
  modified_base 16..17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE 5-methyl cytidine
cccgtattcctcttaccatc

SEQ ID NO: 3671 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphodiester
  modified_base 4: mod_base = OTHER; note = 2'-MOE 5-methyl cytidine 3'-phosphodiester
  modified_base 5: mod_base = OTHER; note = 2'-MOE guanosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-deoxyguanosine 3'-phosphorothioate
  modified_base 15: mod_base = OTHER; note = 2'-deoxythymidine 3'-phosphorothioate
  modified_base 16: mod_base = OTHER; note = 2'-MOE 5-methyl cytidine 3'-phosphodiester
  modified_base 17: mod_base = OTHER; note = 2'-MOE thymidine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
gcacggtattagtgtcttca

SEQ ID NO: 3672 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3..4: mod_base = OTHER; note = 2'-MOE thymidine 3'-phosphodiester
  modified_base 5: mod_base = OTHER; note = 2'-MOE 5-methyl cytidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8..10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14..15: mod_base = OTHER; note = 2'-deoxyguanosine 3'-phosphorothioate
  modified_base 16: mod_base = OTHER; note = 2'-MOE thymidine 3'-phosphodiester
  modified_base 17: mod_base = OTHER; note = 2'-MOE guanosine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE 5-methyl cytidine
gcttctcaaatcaggtgtac

SEQ ID NO: 3673 - DNA, 20 bp, synthetic construct
  source 1..20: mol_type = other DNA
  modified_base 1: mod_base = OTHER; note = 2'-MOE guanosine 3'-phosphorothioate
  modified_base 2..3: mod_base = OTHER; note = 2'-MOE 5-methyl cytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 2'-deoxyadenosine 3'-phosphorothioate
  modified_base 11: mod_base = OTHER; note = 5-methyl 2'-deoxycytidine 3'-phosphorothioate
  modified_base 12..15: mod_base = OTHER; note = 2'-deoxythymidine 3'-phosphorothioate
  modified_base 16: mod_base = OTHER; note = 2'-MOE 5-methyl cytidine 3'-phosphodiester
  modified_base 17: mod_base = OTHER; note = 2'-MOE thymidine 3'-phosphodiester
  modified_base 18..19: mod_base = OTHER; note = 2'-MOE thymidine 3'-phosphorothioate
  modified_base 20: mod_base = OTHER; note = 2'-MOE 5-methyl cytidine
gcctttataacttttctttc

SEQ ID NO: 3674 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE 5-methyl cytidine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6..8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11..12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE guanosine 3'-phosphodiester
  modified_base 17: mod_base = OTHER; note = 2'-MOE 5-methyl cytidine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE thymidine
ttcagtttagttgcagccat

SEQ ID NO: 3675 - DNA, 17 bp, synthetic construct
  source 1..17: mol_type = other DNA
  modified_base 1: mod_base = OTHER; note = 2'-MOE thymidine 3'-phosphorothioate
  modified_base 2: mod_base = OTHER; note = 2'-MOE 5-methyl cytidine 3'-phosphorothioate
  modified_base 3: mod_base = OTHER; note = 2'-MOE adenosine 3'-phosphorothioate
  modified_base 4: mod_base = OTHER; note = 2'-MOE guanosine 3'-phosphodiester
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxyguanosine 3'-phosphorothioate
  modified_base 10..11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 5-methyl 2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine
tcagtttagttgcagcc

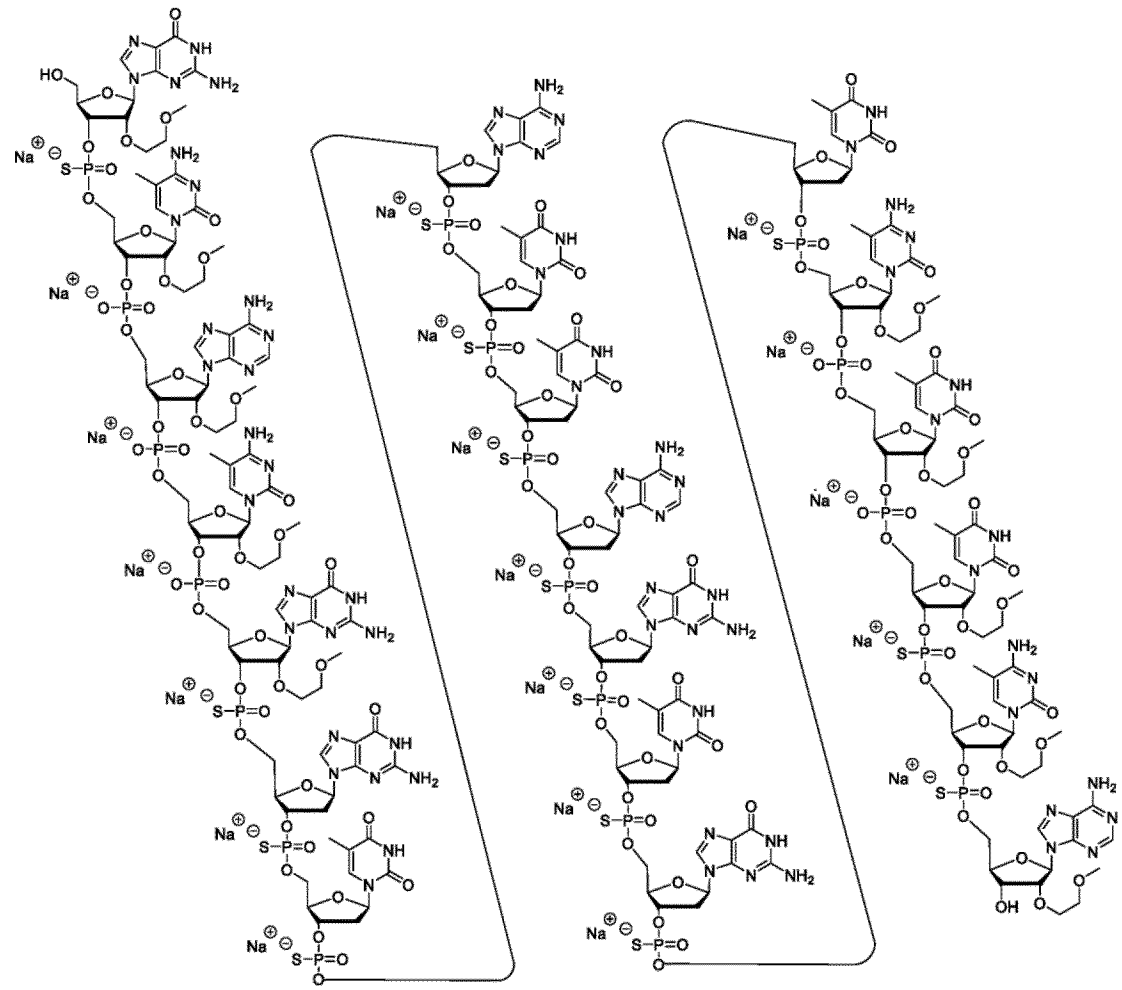

The invention claimed is:

1. A modified oligonucleotide according to the following chemical structure:

(SEQ ID NO: 3671)

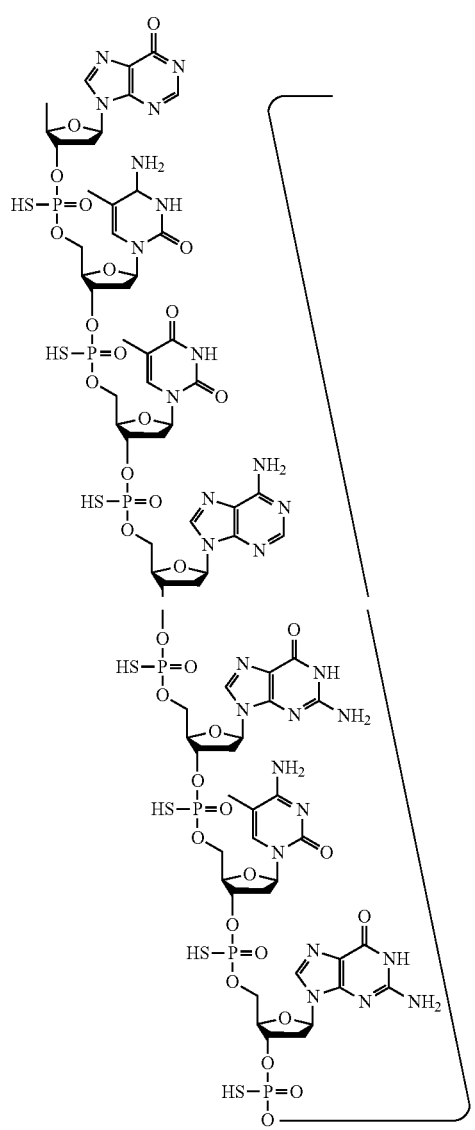
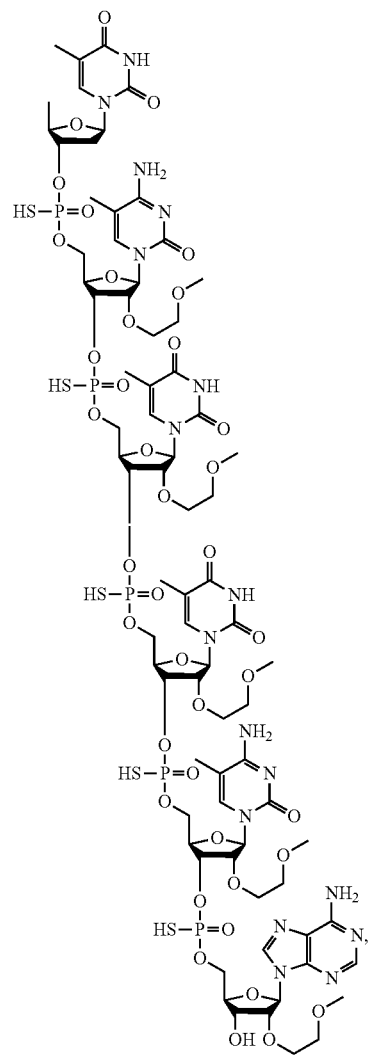
or a salt thereof.
2. A modified oligonucleotide according to the following chemical structure:

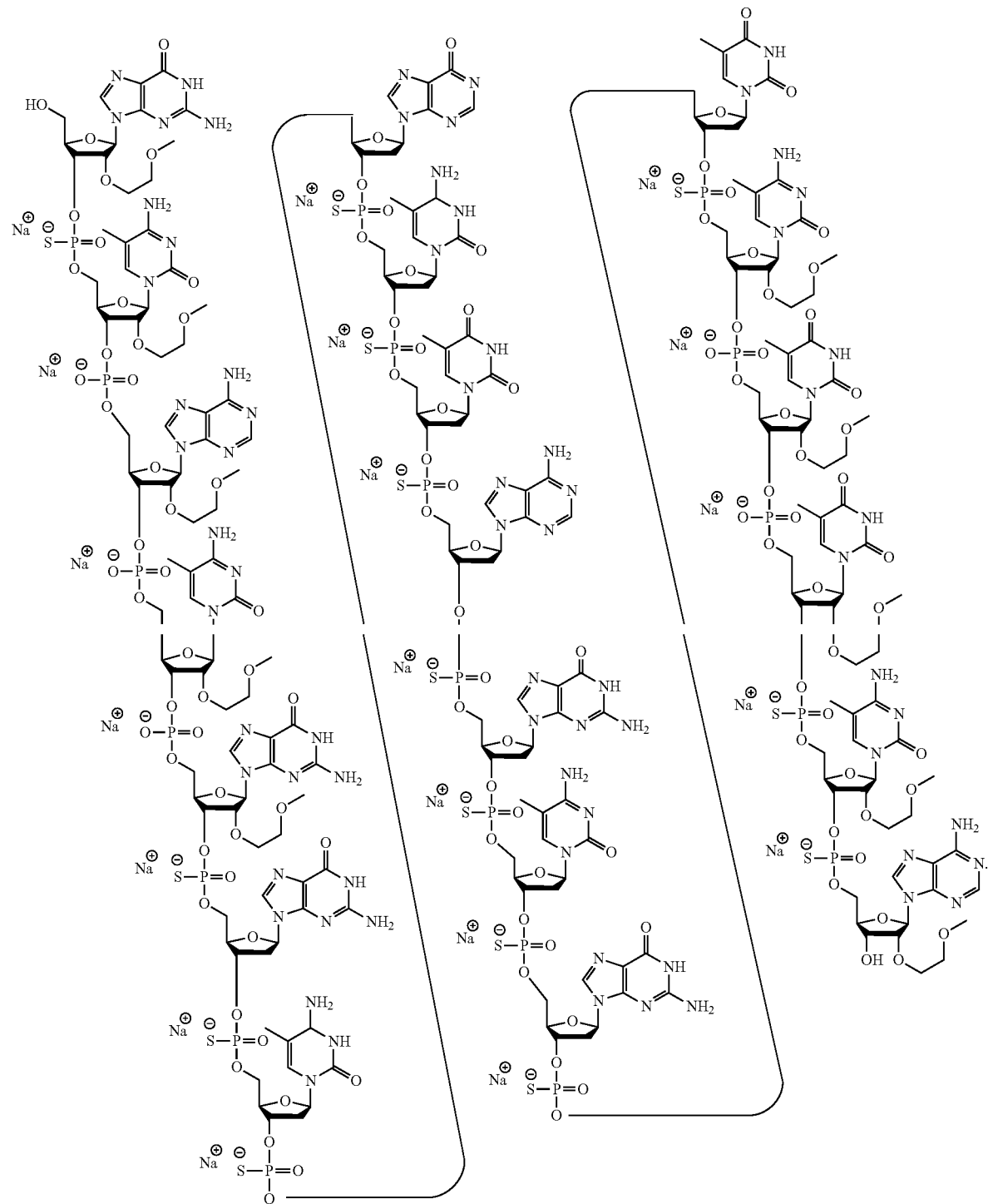
(SEQ ID NO: 3671)

3. An oligomeric compound comprising a modified oligonucleotide according to the following chemical notation:

(SEQ ID NO: 3671)
Ges ᵐCeo Aeo ᵐCeo Ges Gds Tds Ads Tds Tds Ads

Gds Tds Gds Tds ᵐCeo Teo Tes ᵐCes Ae, wherein,
- A=an adenine nucleobase,
- ᵐC=a 5-methylcytosine nucleobase,
- G=a guanine nucleobase,
- T=a thymine nucleobase,
- e=a 2'-MOE sugar moiety,
- d=a 2'-β-D deoxyribosyl sugar moiety,
- s=a phosphorothioate internucleoside linkage, and
- o=a phosphodiester internucleoside linkage.

4. The modified oligonucleotide of claim 1, which is a sodium salt or a potassium salt.

5. A population of modified oligonucleotides of claim 1, wherein all of the phosphorothioate internucleoside linkages of the modified oligonucleotides are stereorandom.

6. A population of modified oligonucleotides of claim 4, wherein all of the phosphorothioate internucleoside linkages of the modified oligonucleotides are stereorandom.

7. A population of modified oligonucleotides of claim 2, wherein all of the phosphorothioate internucleoside linkages of the modified oligonucleotides are stereorandom.

8. A population of oligomeric compounds of claim 3, wherein all of the phosphorothioate internucleoside linkages of the modified oligonucleotides are stereorandom.

9. A pharmaceutical composition comprising the modified oligonucleotide of claim 1, and a pharmaceutically acceptable diluent.

10. The pharmaceutical composition of claim 9, wherein the pharmaceutically acceptable diluent is phosphate-buffered saline (PBS) or artificial cerebrospinal fluid.

11. The pharmaceutical composition of claim 10, wherein the pharmaceutical composition consists essentially of the modified oligonucleotide and artificial cerebrospinal fluid.

12. The pharmaceutical composition of claim 10, wherein the pharmaceutical composition consists essentially of the modified oligonucleotide and PBS.

13. A pharmaceutical composition comprising the modified oligonucleotide of claim 4, and a pharmaceutically acceptable diluent.

14. The pharmaceutical composition of claim 13, wherein the pharmaceutically acceptable diluent is phosphate-buffered saline (PBS) or artificial cerebrospinal fluid.

15. The pharmaceutical composition of claim 14, wherein the pharmaceutical composition consists essentially of the modified oligonucleotide and artificial cerebrospinal fluid.

16. The pharmaceutical composition of claim 14, wherein the pharmaceutical composition consists essentially of the modified oligonucleotide and PBS.

17. A pharmaceutical composition comprising the modified oligonucleotide of claim 2, and a pharmaceutically acceptable diluent.

18. The pharmaceutical composition of claim 17, wherein the pharmaceutically acceptable diluent is phosphate-buffered saline (PBS) or artificial cerebrospinal fluid.

19. The pharmaceutical composition of claim 18, wherein the pharmaceutical composition consists essentially of the modified oligonucleotide and artificial cerebrospinal fluid.

20. The pharmaceutical composition of claim 18, wherein the pharmaceutical composition consists essentially of the modified oligonucleotide and PBS.

21. A pharmaceutical composition comprising the oligomeric compound of claim 3, and a pharmaceutically acceptable diluent.

22. The pharmaceutical composition of claim 21, wherein the pharmaceutically acceptable diluent is phosphate-buffered saline (PBS) or artificial cerebrospinal fluid.

23. The pharmaceutical composition of claim 22, wherein the pharmaceutical composition consists essentially of the oligomeric compound and artificial cerebrospinal fluid.

24. The pharmaceutical composition of claim 22, wherein the pharmaceutical composition consists essentially of the oligomeric compound and PBS.

25. A pharmaceutical composition comprising the population of modified oligonucleotides of claim 5, and a pharmaceutically acceptable diluent.

26. The pharmaceutical composition of claim 25, wherein the pharmaceutically acceptable diluent is phosphate-buffered saline (PBS) or artificial cerebrospinal fluid.

27. A pharmaceutical composition comprising the population of modified oligonucleotides of claim 7, and a pharmaceutically acceptable diluent.

28. The pharmaceutical composition of claim 27, wherein the pharmaceutically acceptable diluent is phosphate-buffered saline (PBS) or artificial cerebrospinal fluid.

29. A pharmaceutical composition comprising the population of oligomeric compounds of claim 8, and a pharmaceutically acceptable diluent.

30. The pharmaceutical composition of claim 29, wherein the pharmaceutically acceptable diluent is phosphate-buffered saline (PBS) or artificial cerebrospinal fluid.

* * * * *

UNITED STATES PATENT AND TRADEMARK OFFICE
CERTIFICATE OF CORRECTION

PATENT NO. : 12,180,479 B2
APPLICATION NO. : 18/047973
DATED : December 31, 2024
INVENTOR(S) : Susan M. Freier Page 1 of 38

It is certified that error appears in the above-identified patent and that said Letters Patent is hereby corrected as shown below:

In the Specification

In Columns 13-16, the structure should read:

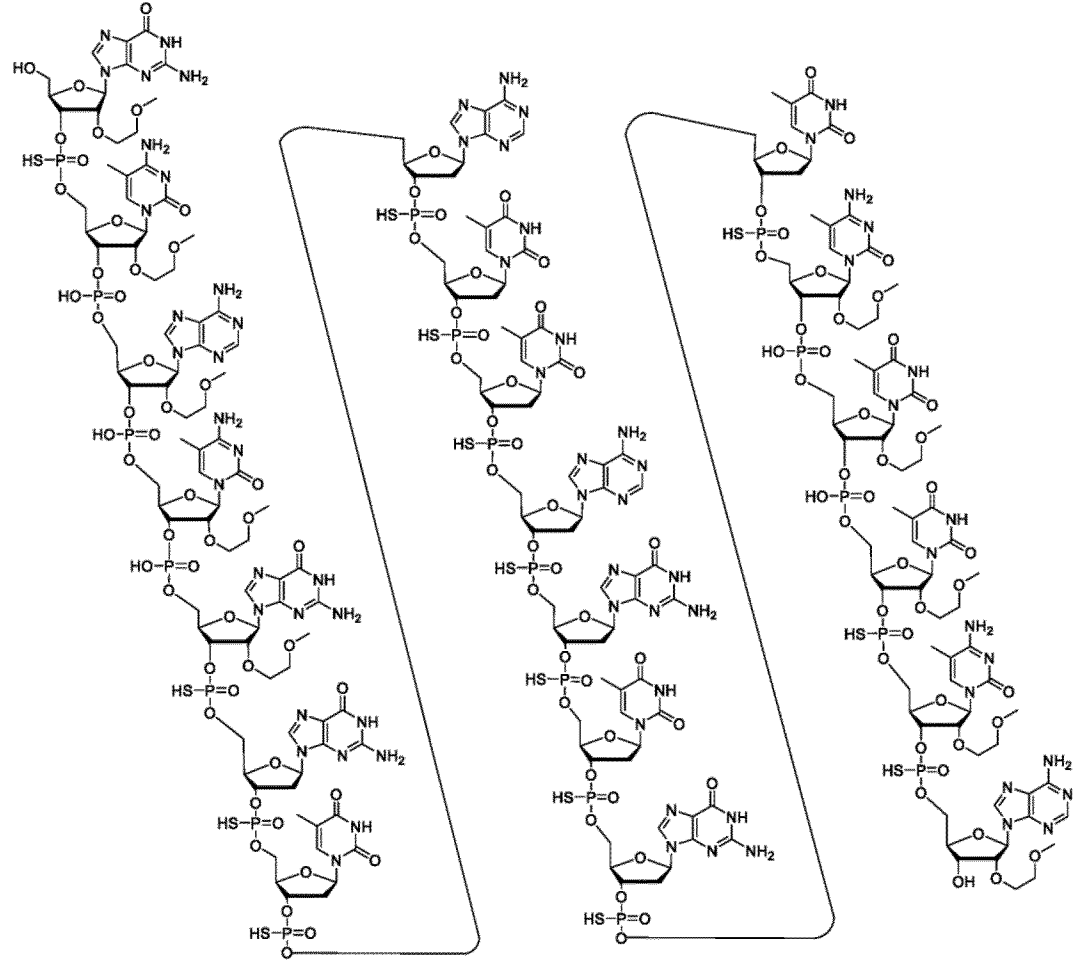

Signed and Sealed this
First Day of April, 2025

Coke Morgan Stewart
*Acting Director of the United States Patent and Trademark Office*

In Columns 15-18, the structure should read:
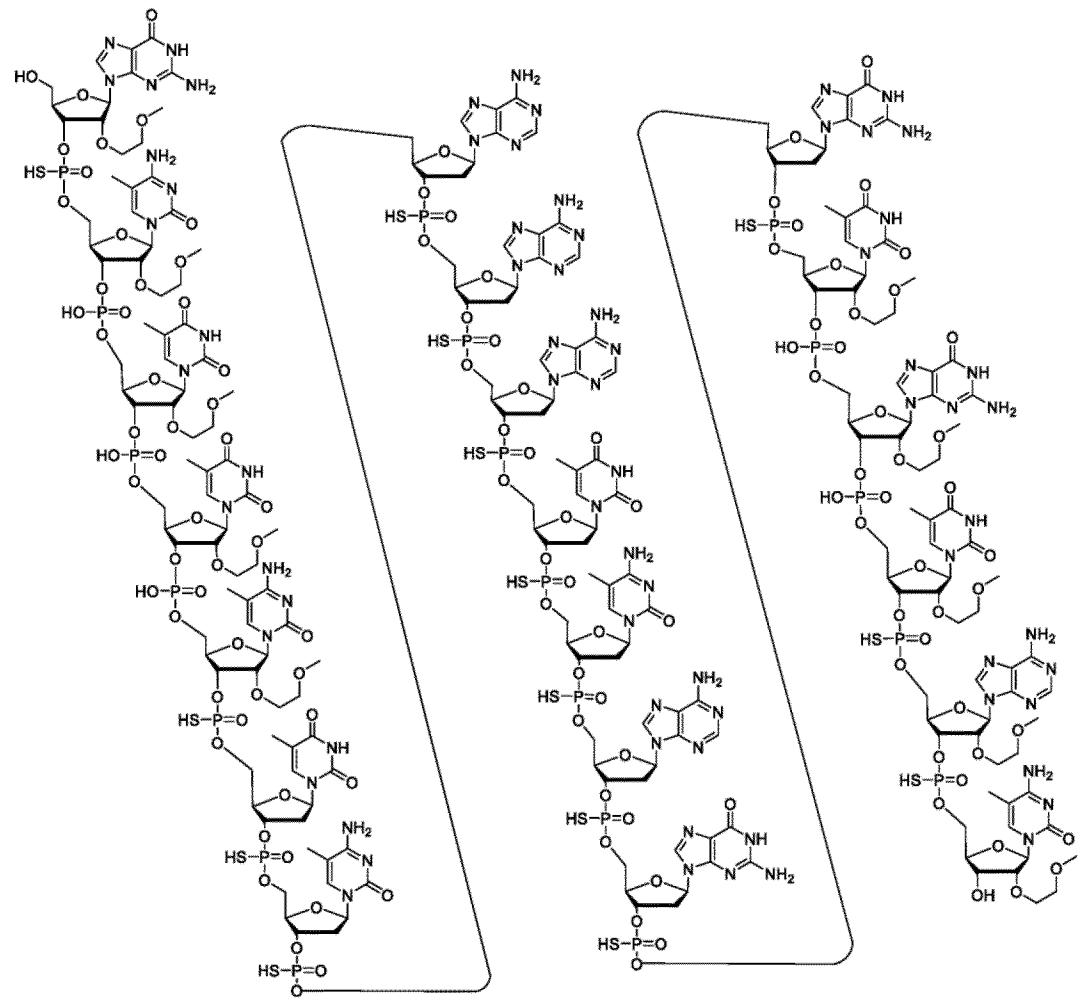

CERTIFICATE OF CORRECTION (continued)
U.S. Pat. No. 12,180,479 B2

In Columns 17-20, the structure should read:

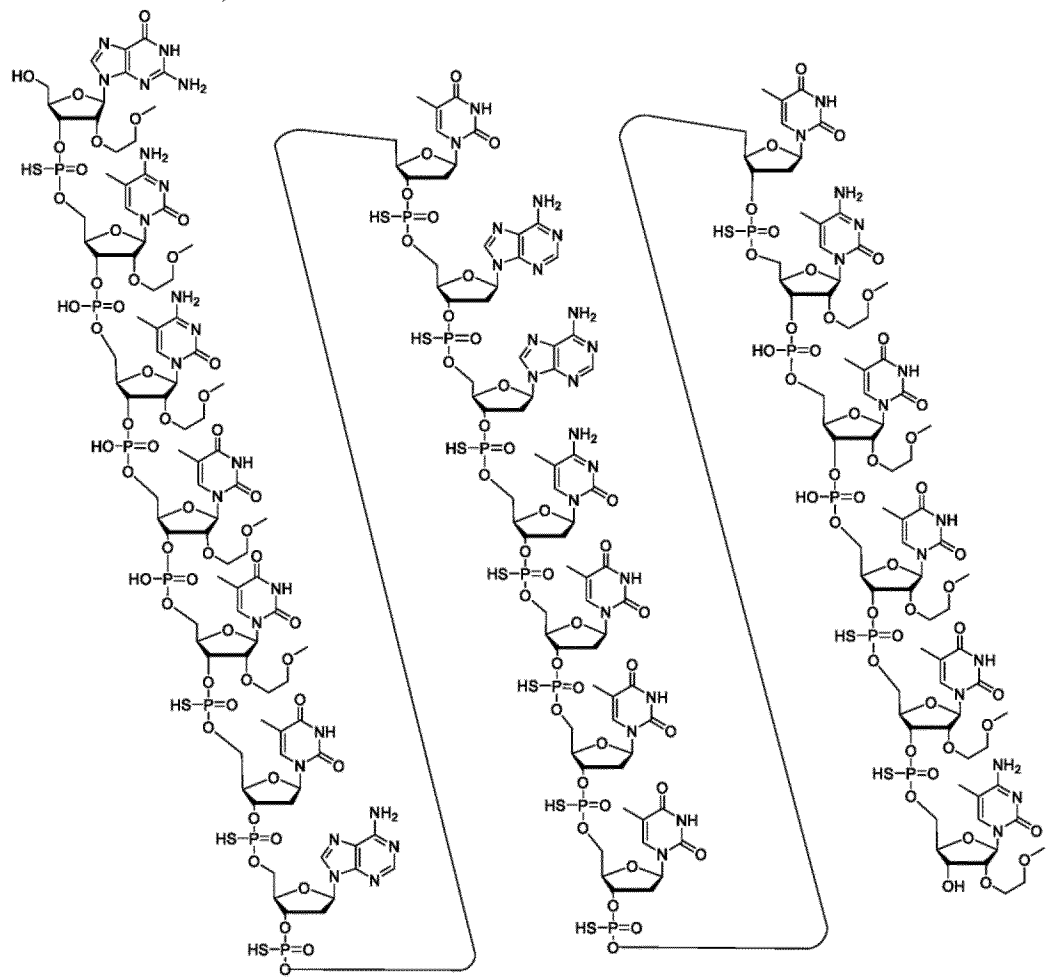

In Columns 19-22, the structure should read:
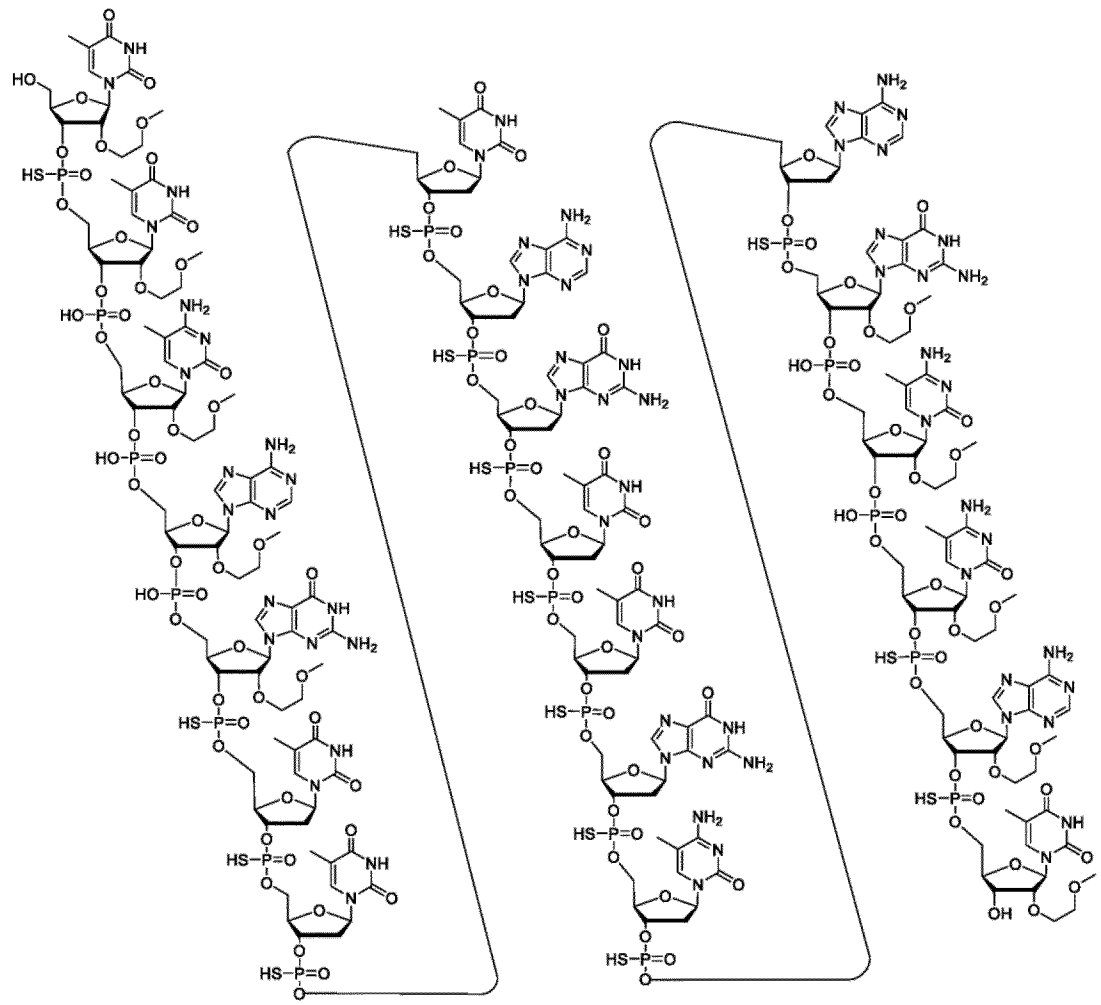

CERTIFICATE OF CORRECTION (continued)
U.S. Pat. No. 12,180,479 B2

In Columns 21-24, the structure should read:

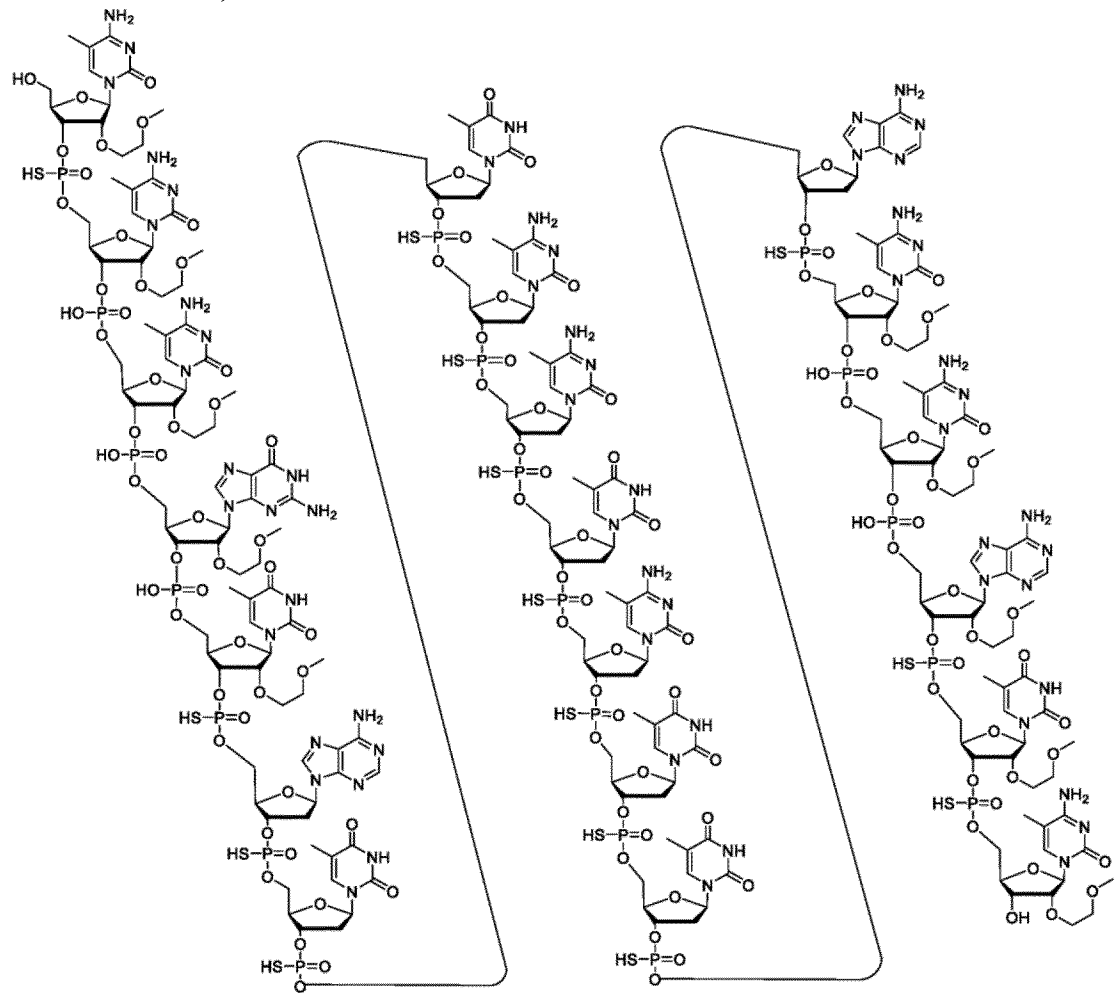

In Columns 23-26, the structure should read:
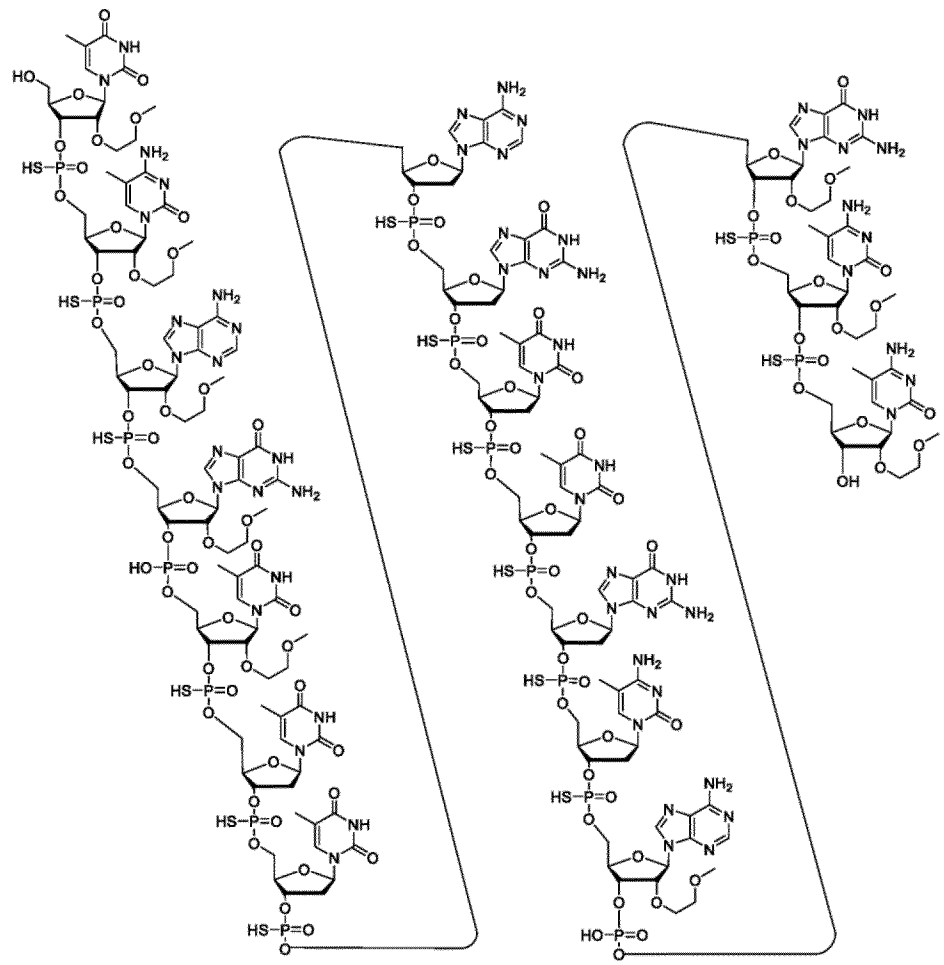

CERTIFICATE OF CORRECTION (continued)
U.S. Pat. No. 12,180,479 B2

In Columns 25-28, the structure should read:

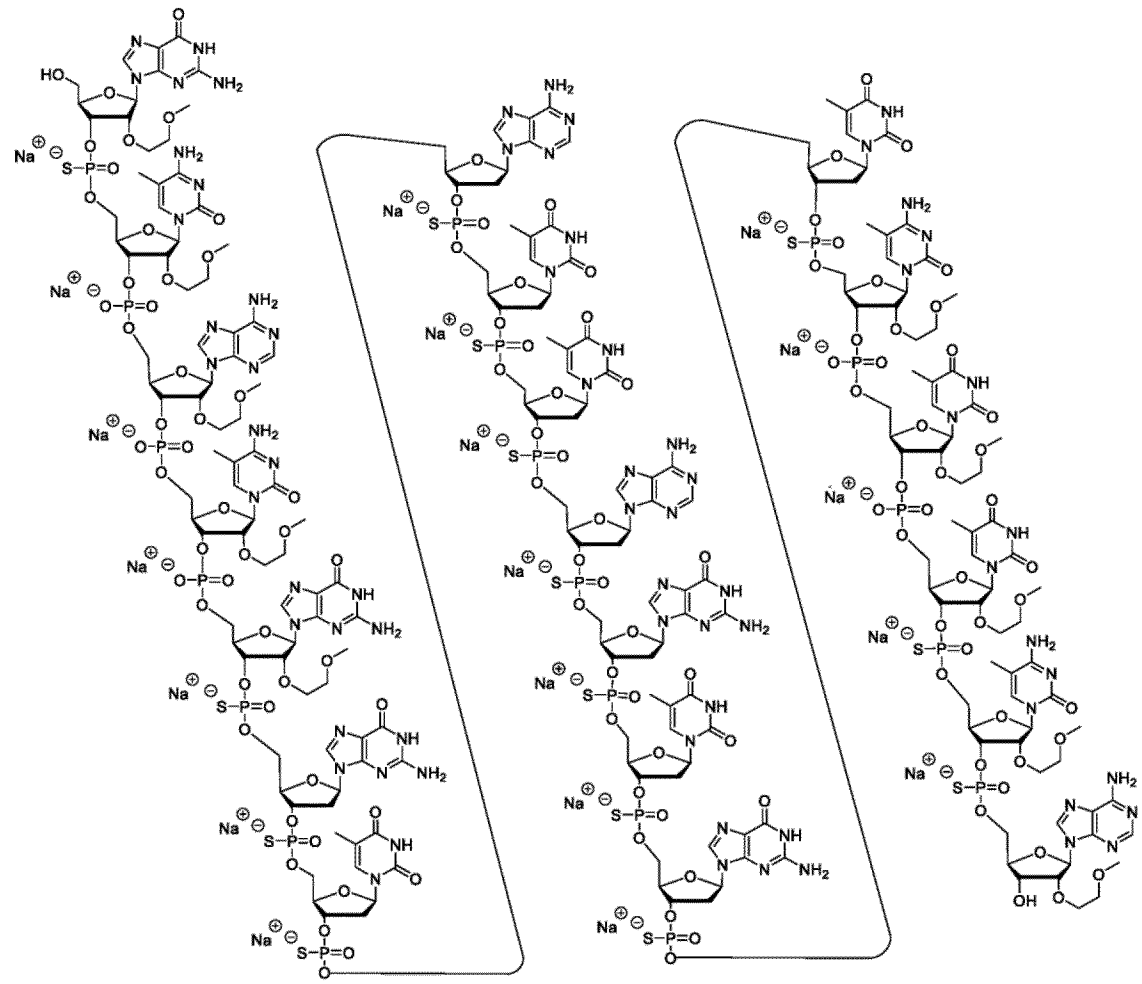

CERTIFICATE OF CORRECTION (continued)
U.S. Pat. No. 12,180,479 B2

In Columns 27-30, the structure should read:

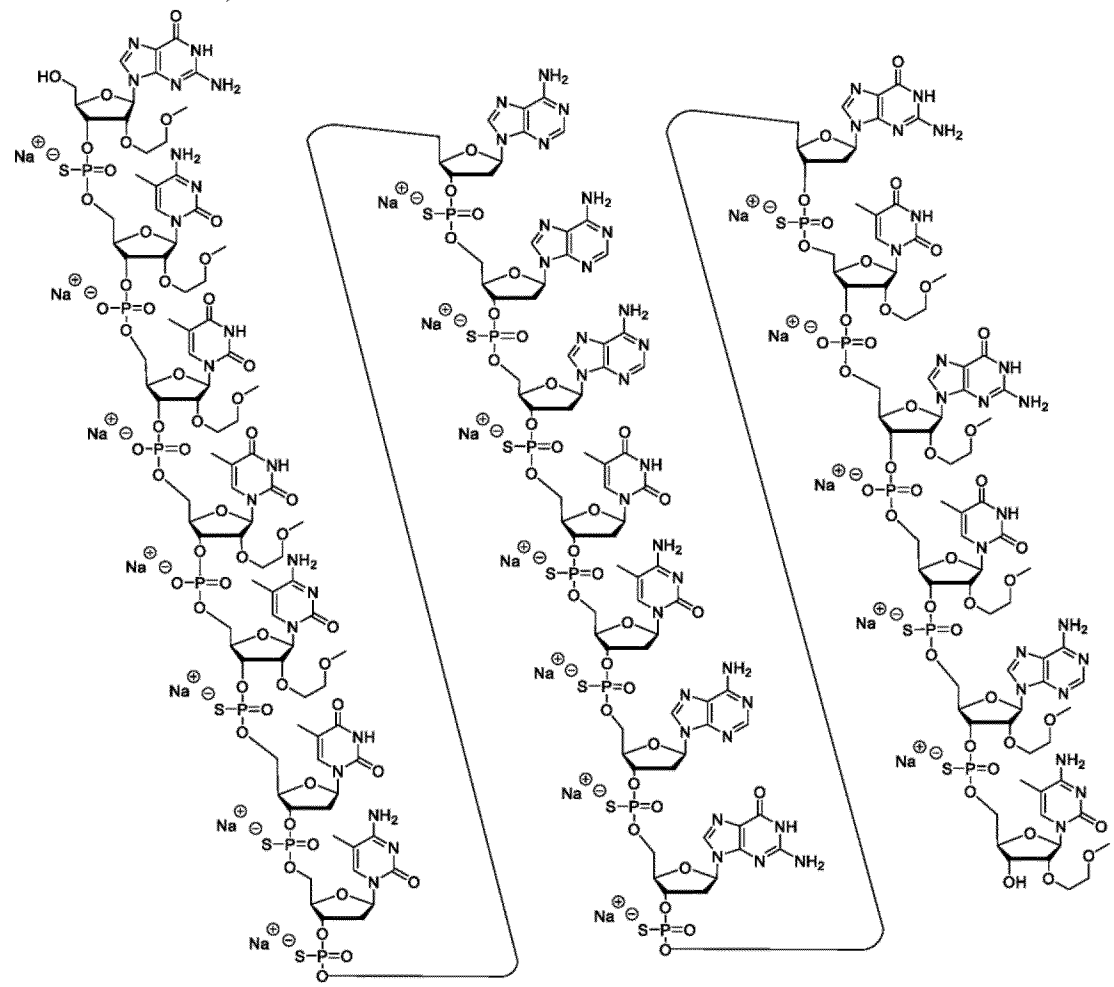

CERTIFICATE OF CORRECTION (continued)
U.S. Pat. No. 12,180,479 B2

In Columns 29-32, the structure should read:

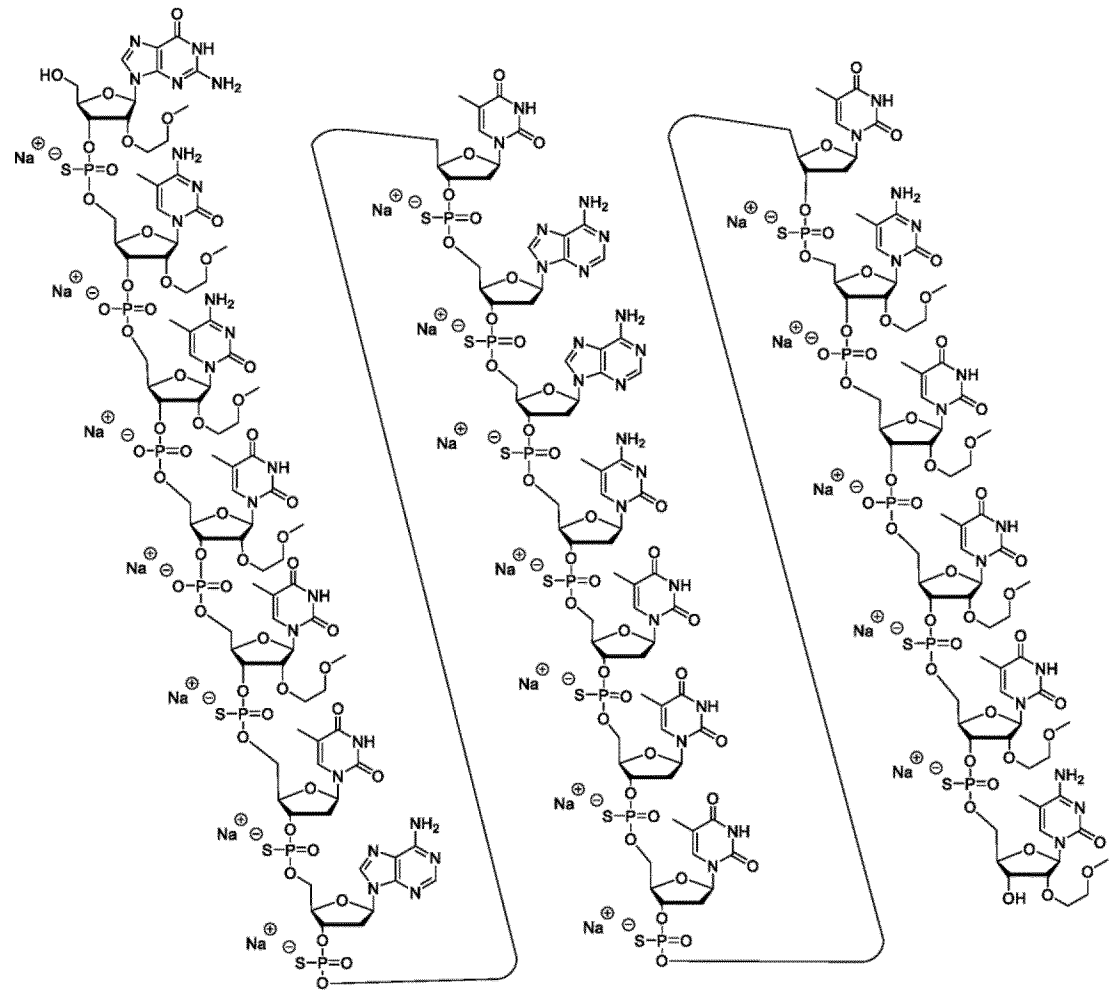

CERTIFICATE OF CORRECTION (continued)
U.S. Pat. No. 12,180,479 B2

In Columns 31-34, the structure should read:

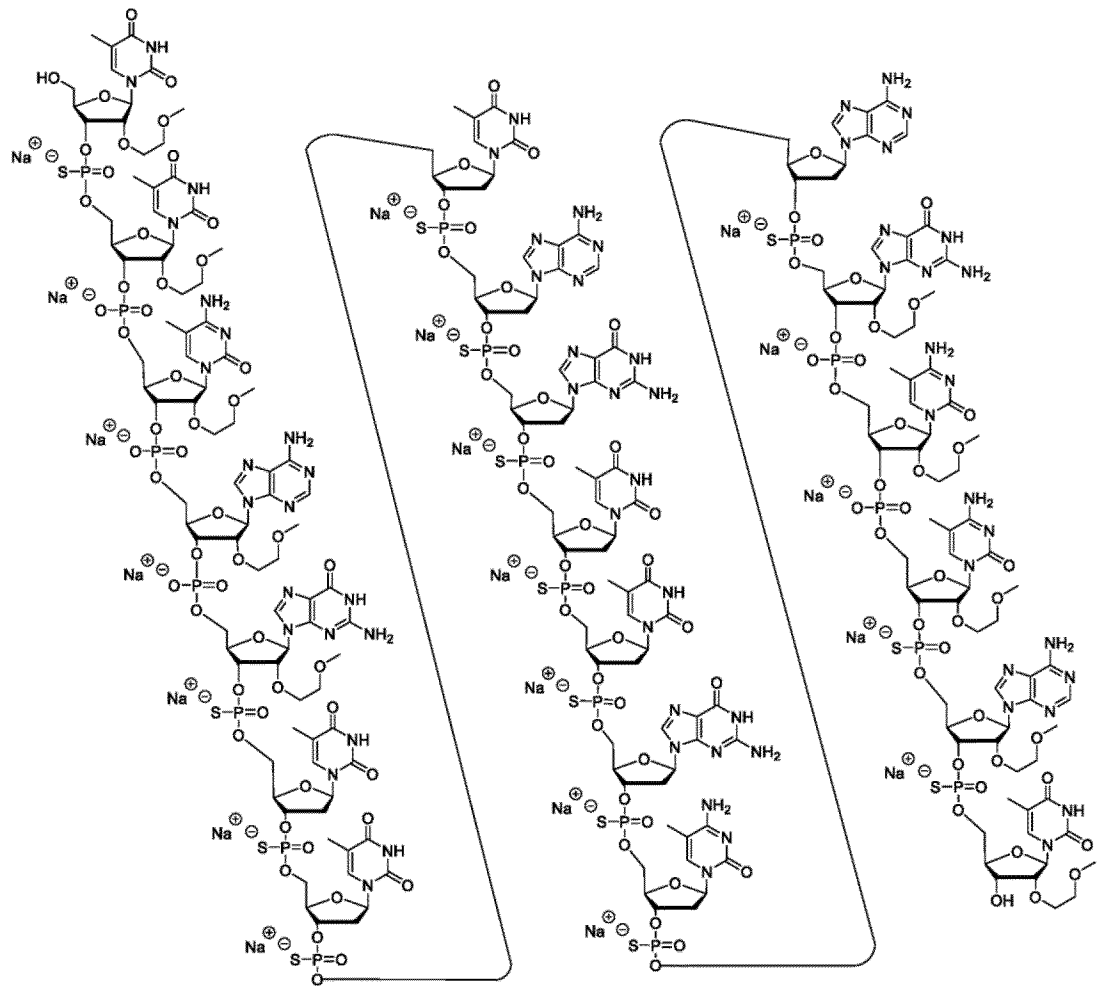

CERTIFICATE OF CORRECTION (continued)
U.S. Pat. No. 12,180,479 B2

In Columns 33-36, the structure should read:

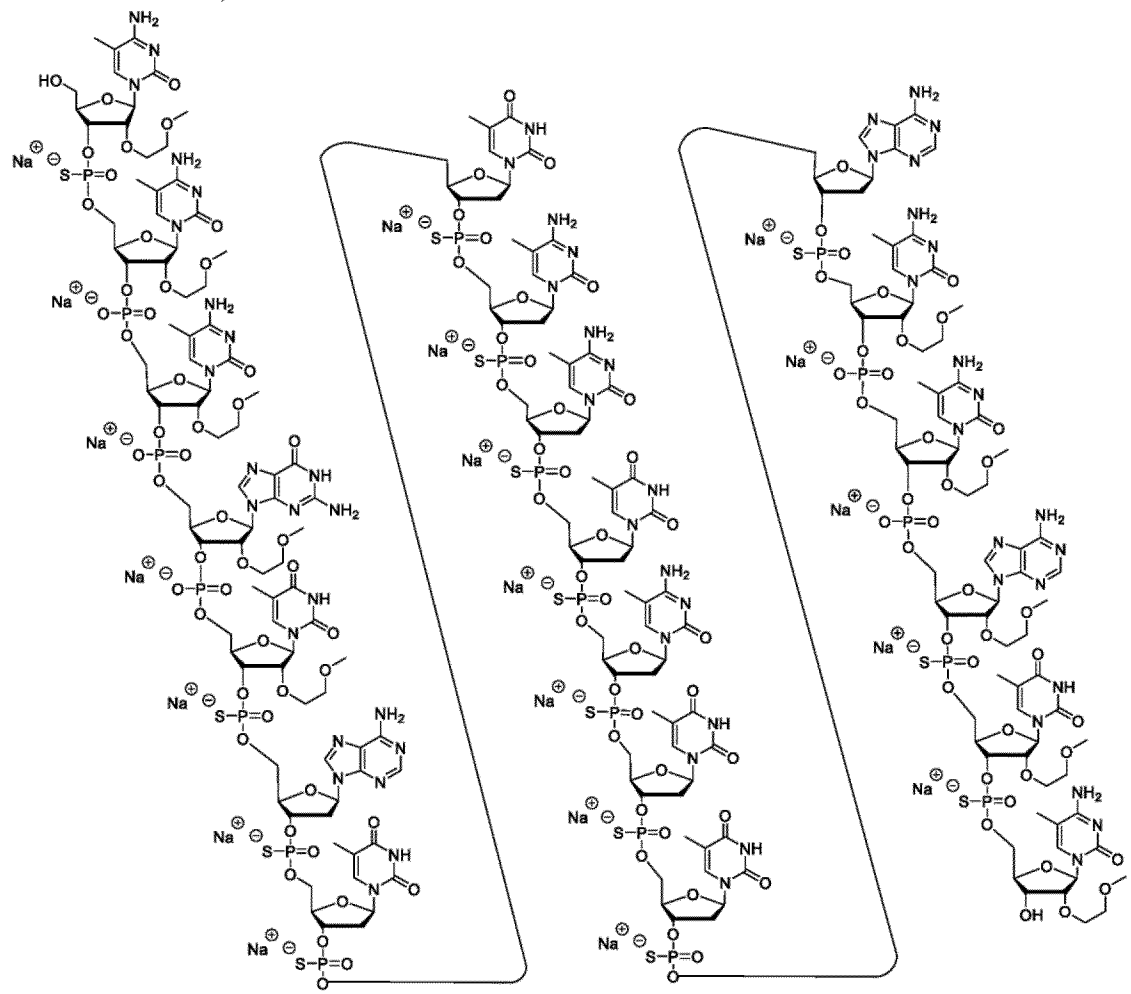

CERTIFICATE OF CORRECTION (continued)
U.S. Pat. No. 12,180,479 B2

In Columns 35-36, the structure should read:

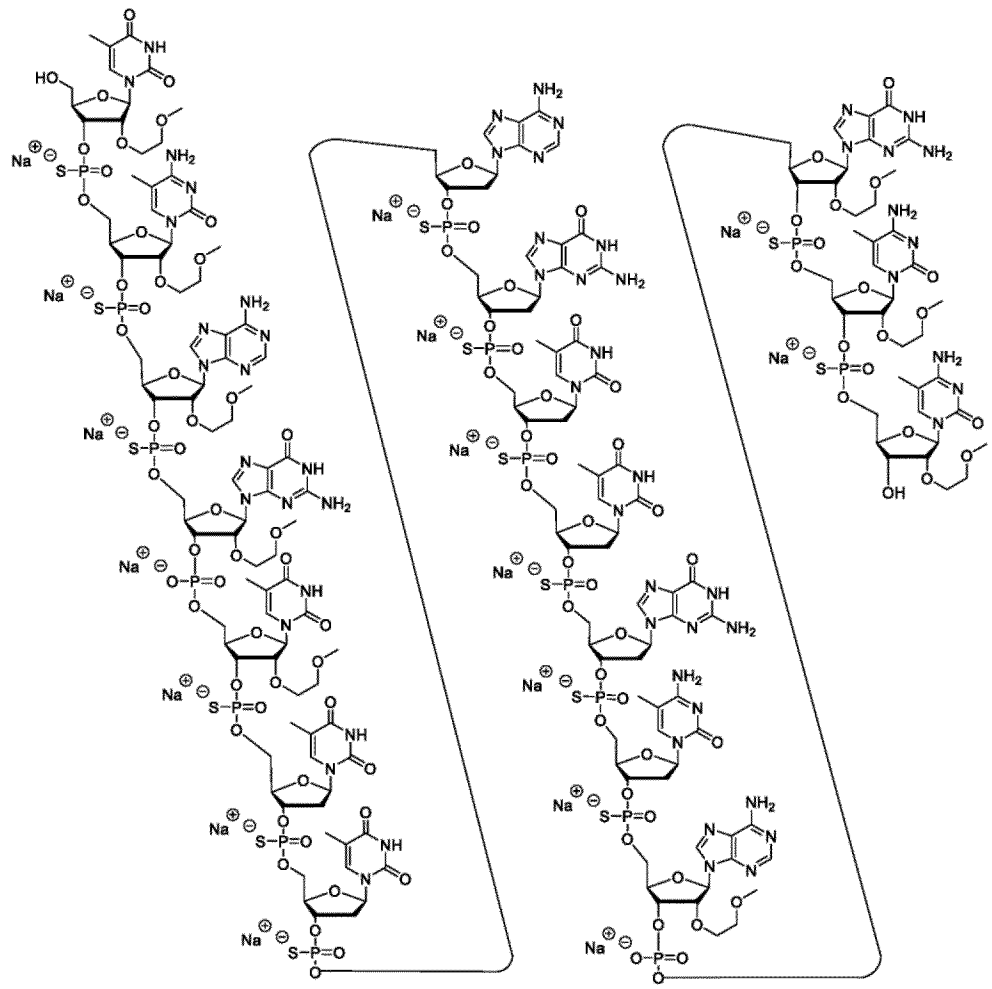

CERTIFICATE OF CORRECTION (continued)
U.S. Pat. No. 12,180,479 B2

In Columns 45-48, the structure should read:

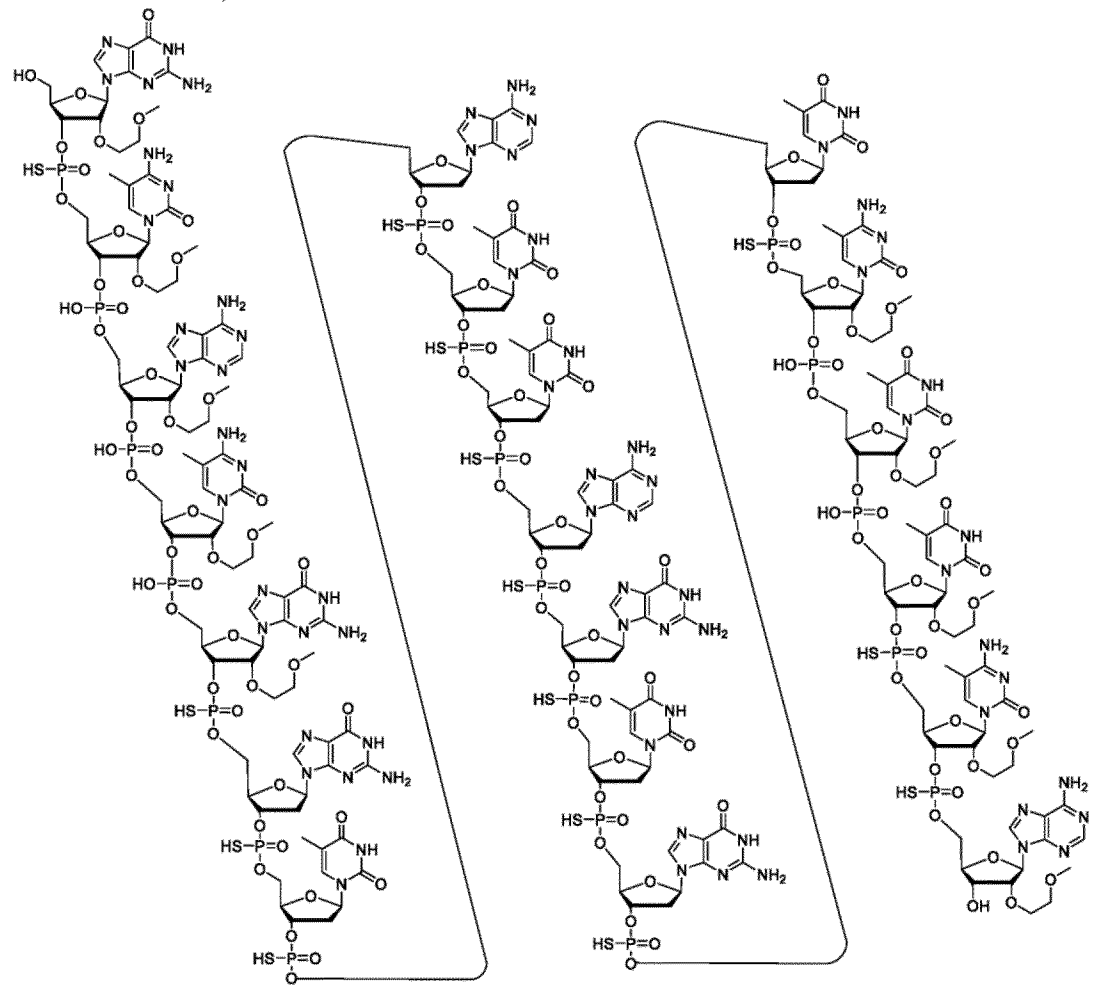

In Columns 47-50, the structure should read:
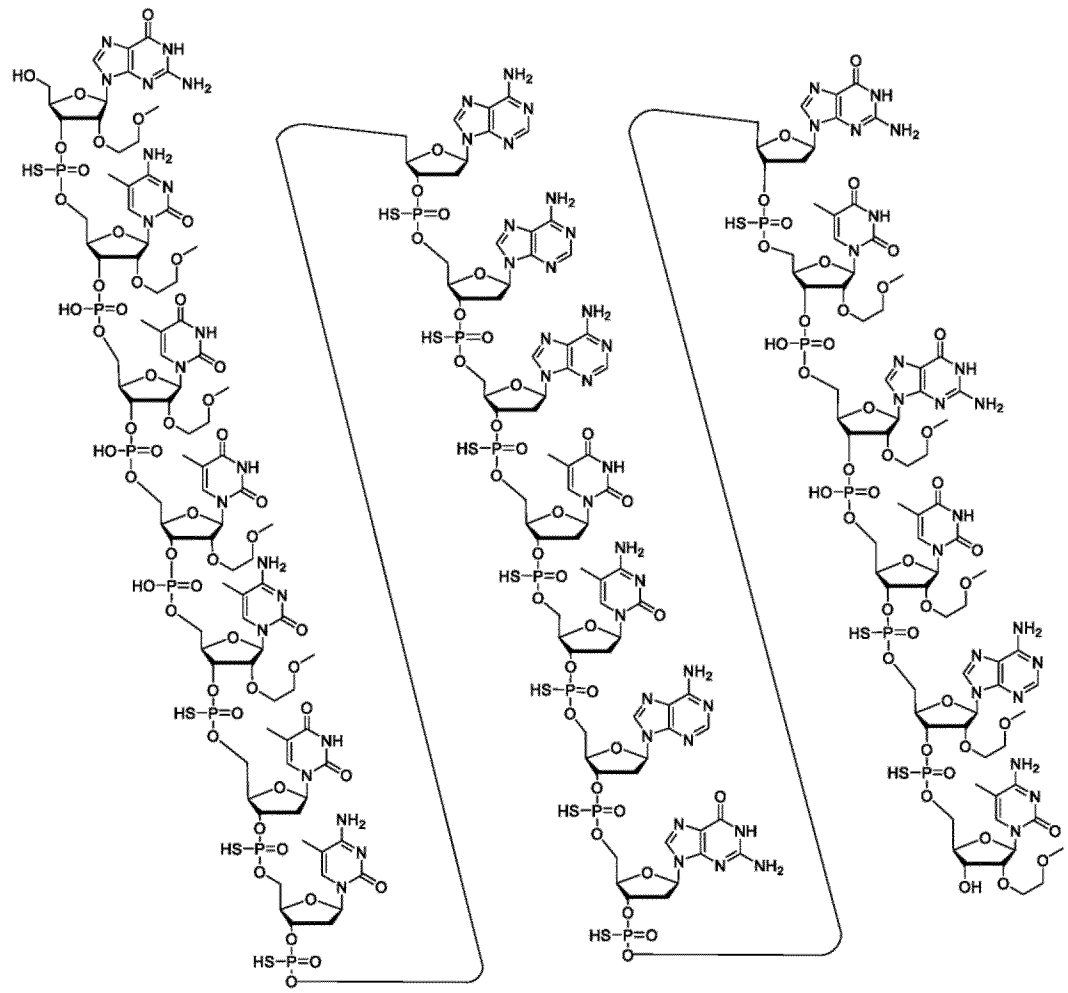

CERTIFICATE OF CORRECTION (continued)
U.S. Pat. No. 12,180,479 B2

In Columns 49-52, the structure should read:

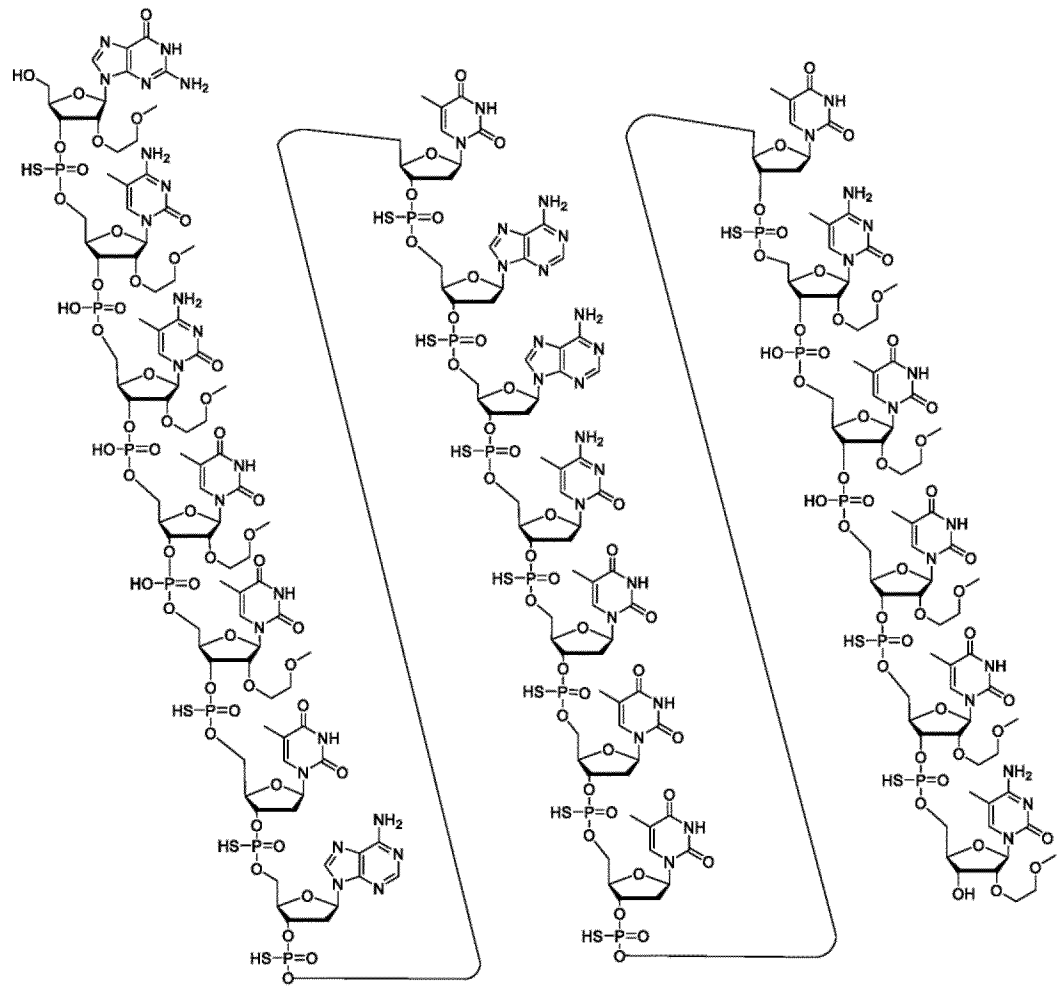

CERTIFICATE OF CORRECTION (continued)
U.S. Pat. No. 12,180,479 B2

In Columns 51-54, the structure should read:

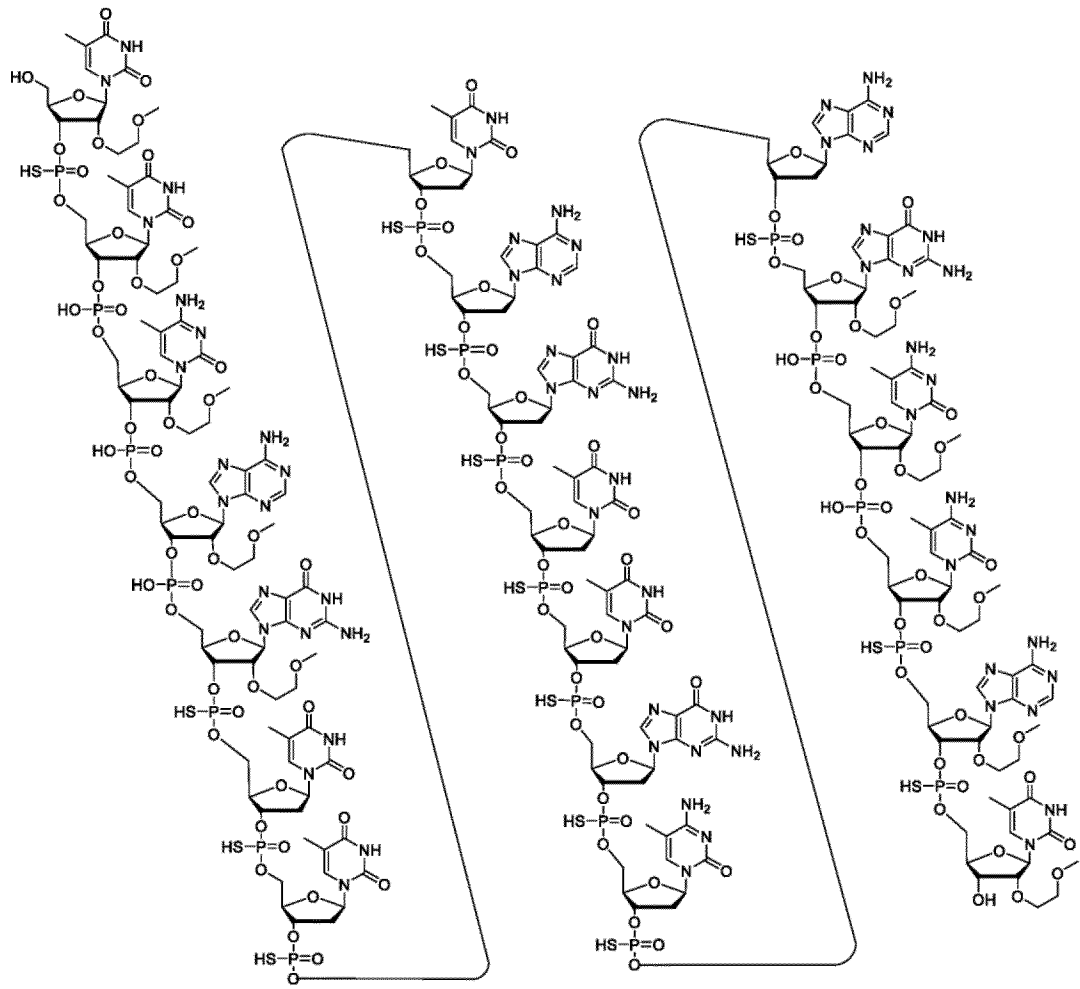

CERTIFICATE OF CORRECTION (continued)
U.S. Pat. No. 12,180,479 B2

In Columns 53-56, the structure should read:

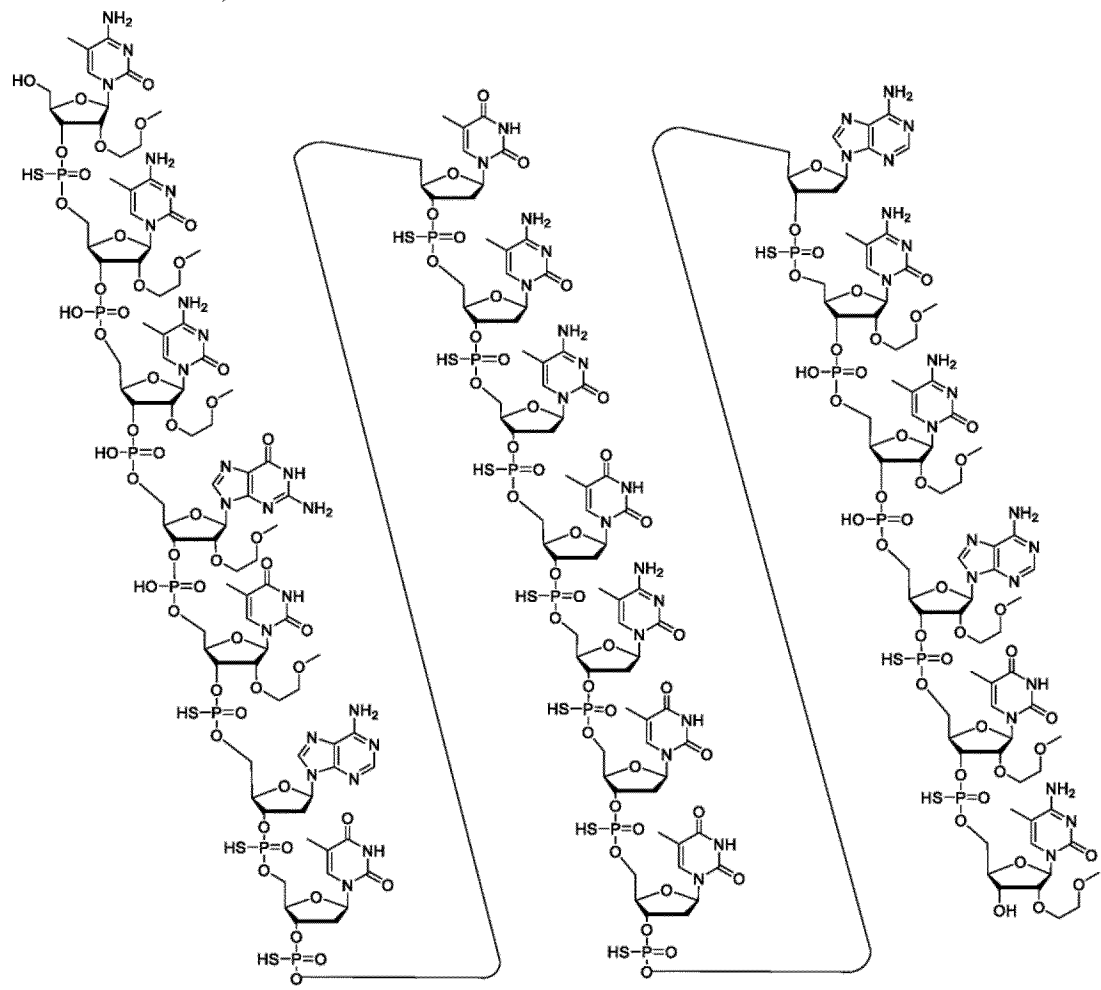

CERTIFICATE OF CORRECTION (continued)
U.S. Pat. No. 12,180,479 B2

In Columns 55-58, the structure should read:

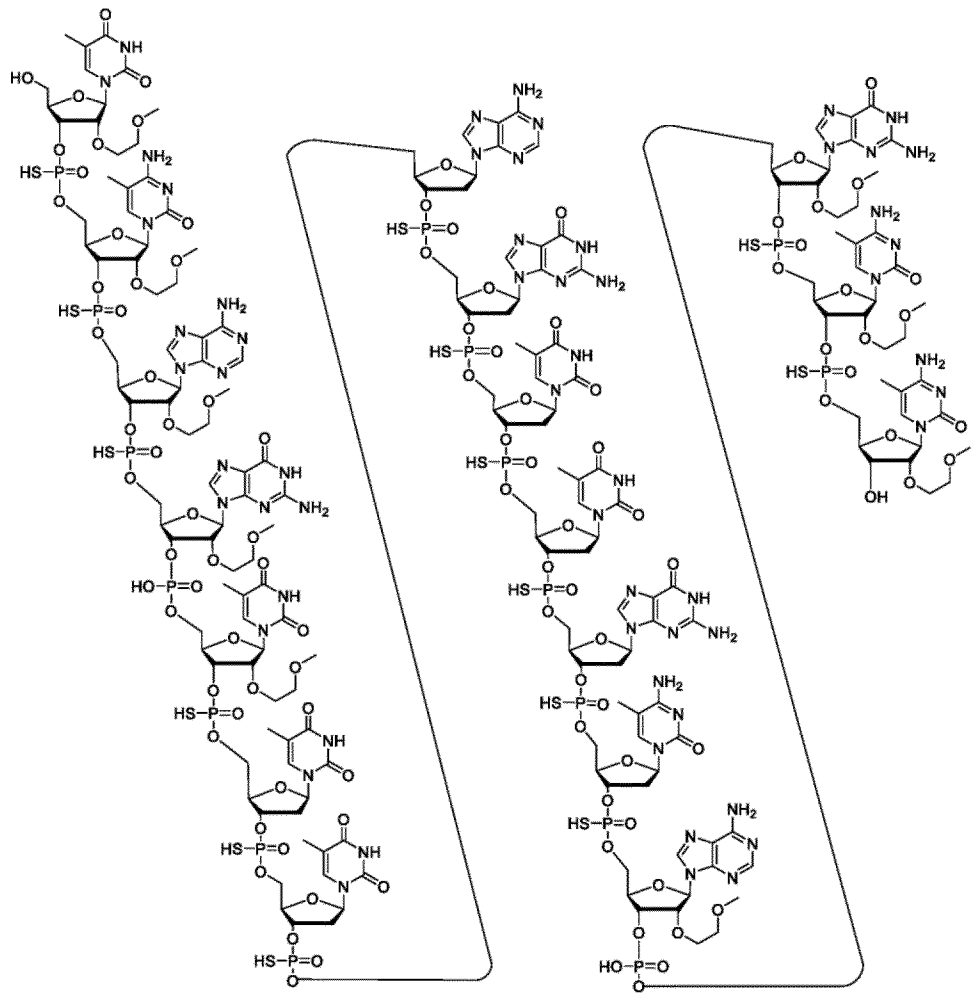

CERTIFICATE OF CORRECTION (continued)
U.S. Pat. No. 12,180,479 B2

In Columns 57-60, the structure should read:

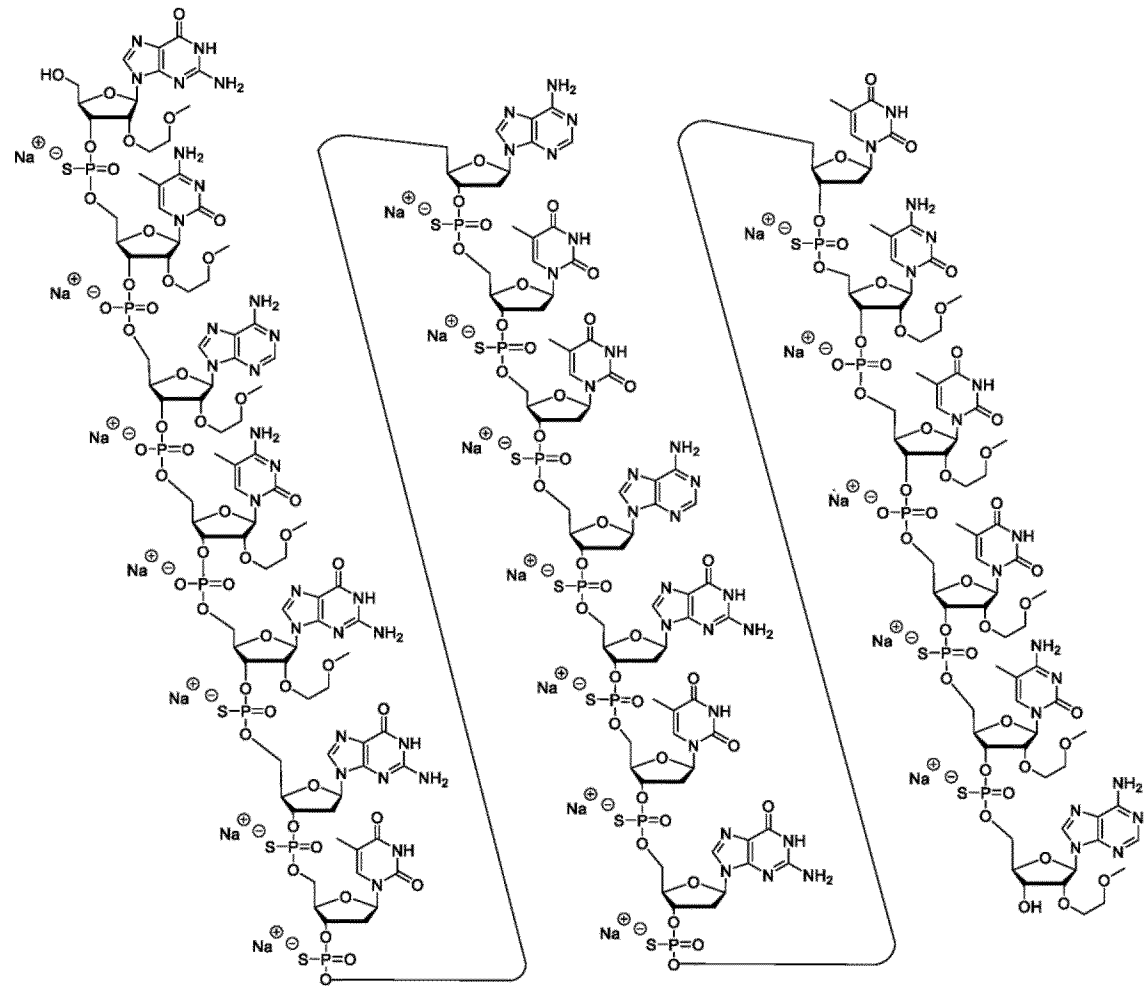

CERTIFICATE OF CORRECTION (continued)
U.S. Pat. No. 12,180,479 B2

In Columns 59-62, the structure should read:

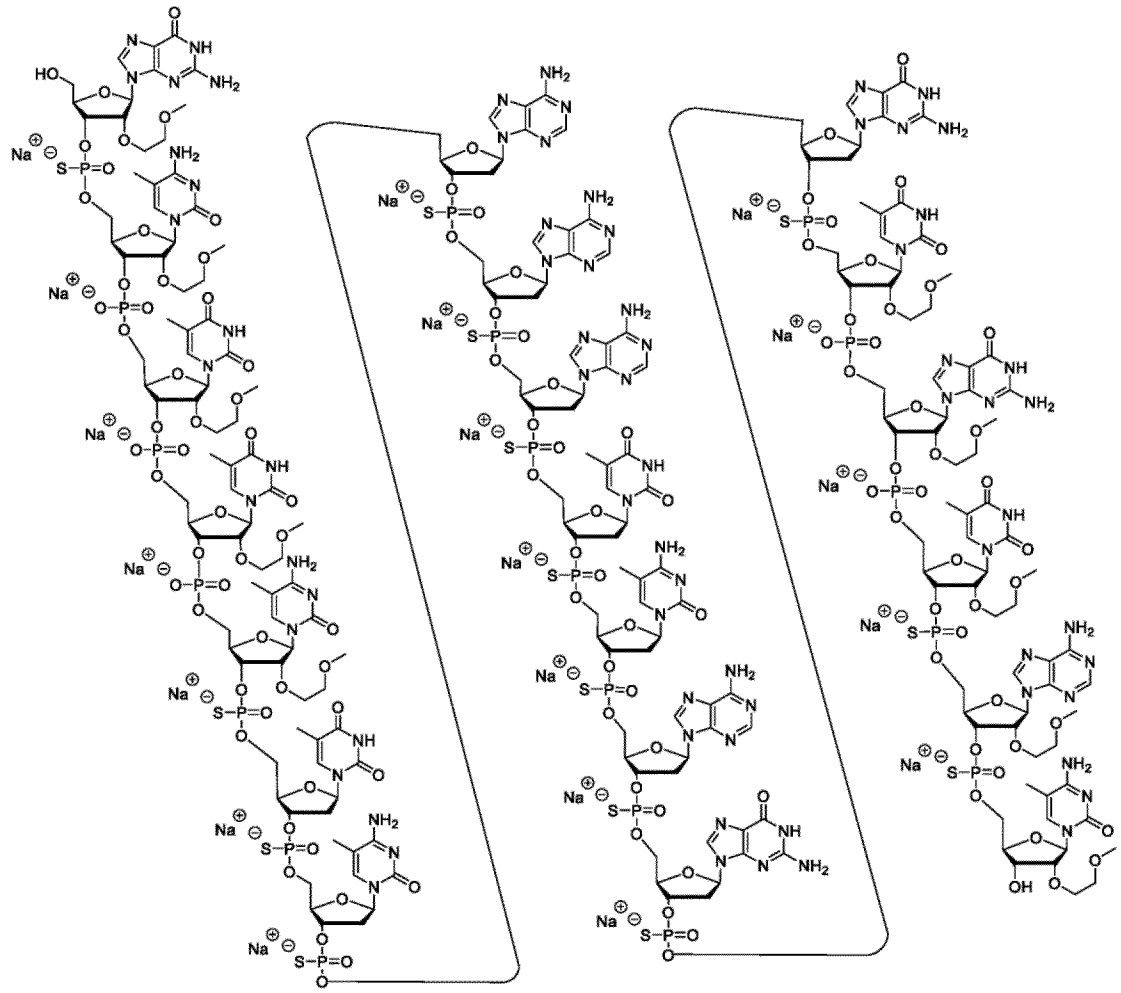

CERTIFICATE OF CORRECTION (continued)
U.S. Pat. No. 12,180,479 B2

In Columns 61-64, the structure should read:

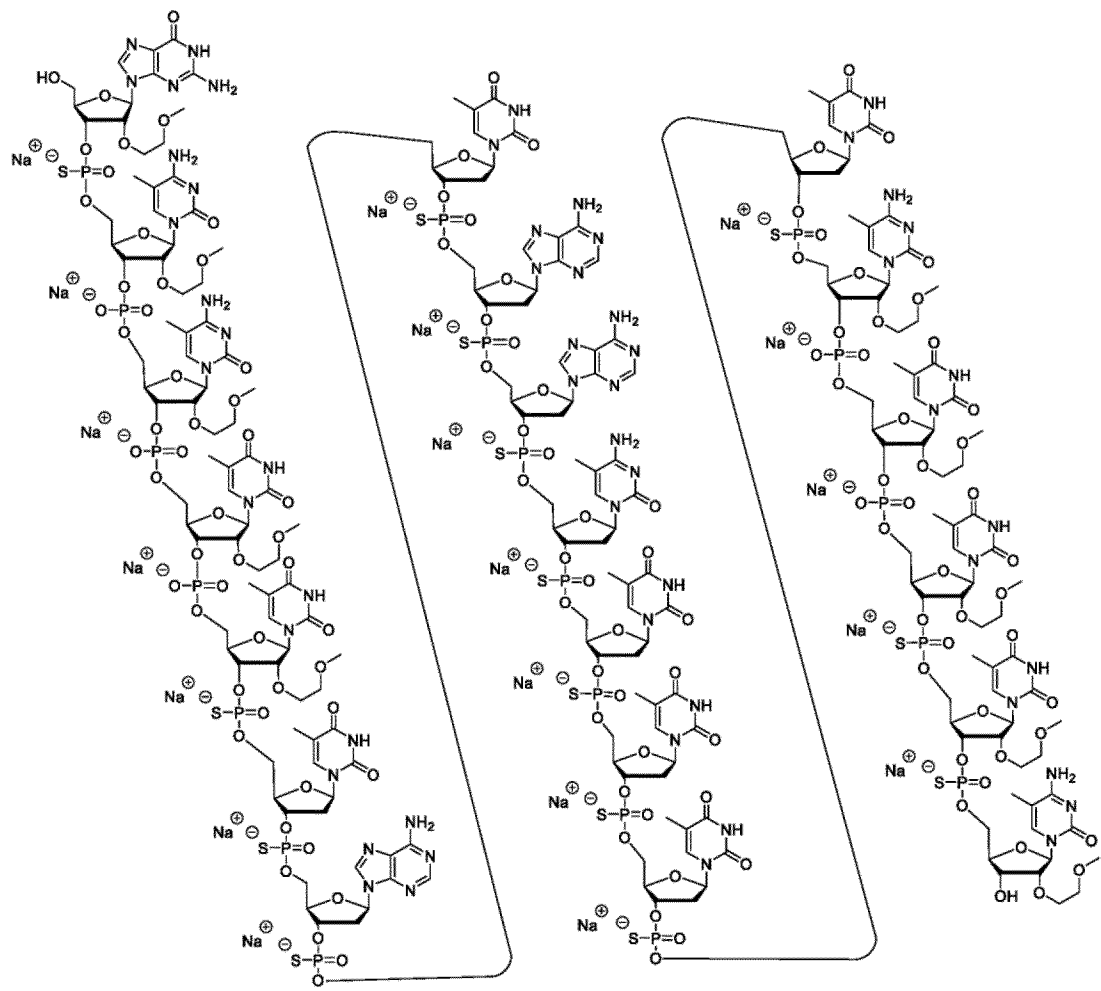

CERTIFICATE OF CORRECTION (continued)
U.S. Pat. No. 12,180,479 B2

In Columns 63-66, the structure should read:

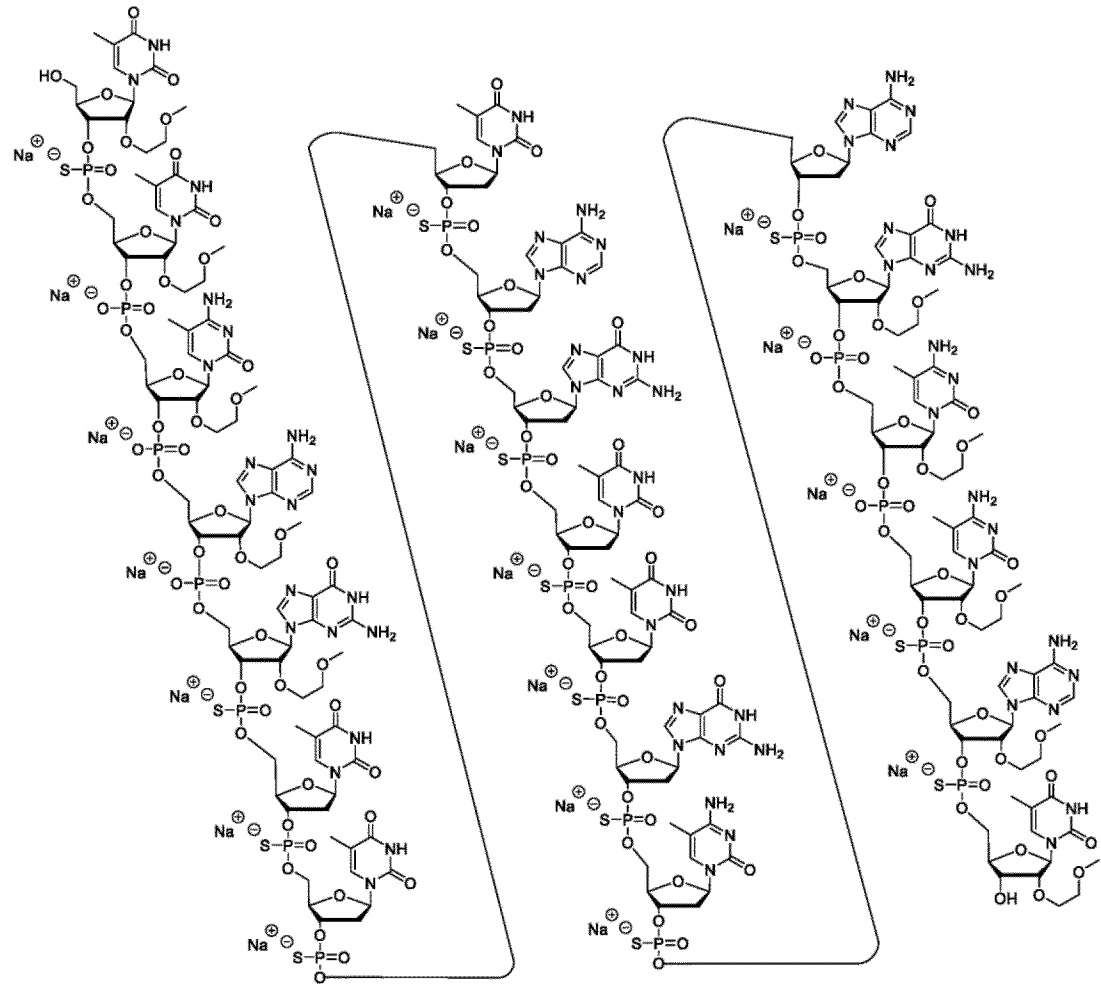

CERTIFICATE OF CORRECTION (continued)
U.S. Pat. No. 12,180,479 B2

In Columns 65-68, the structure should read:

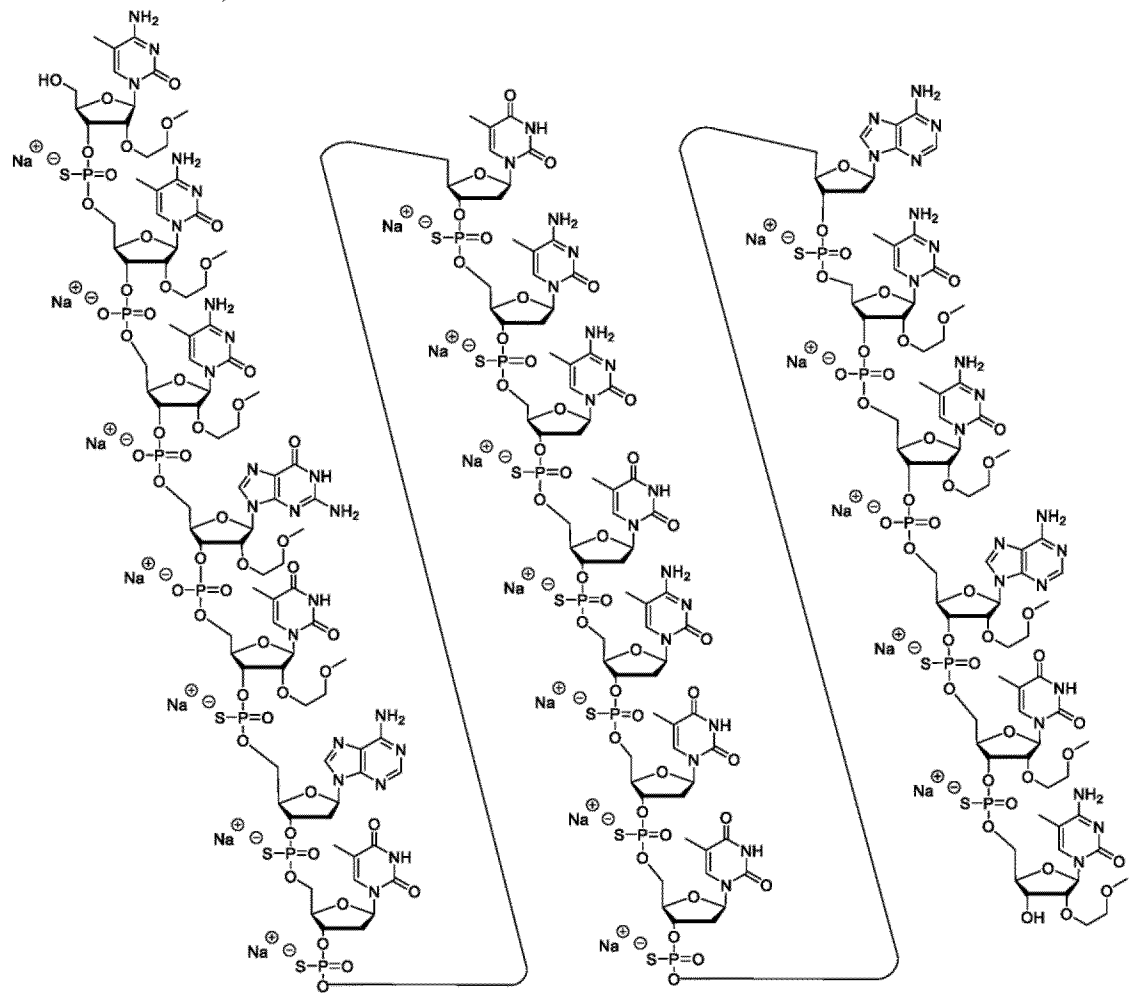

In Columns 67-70, the structure should read:
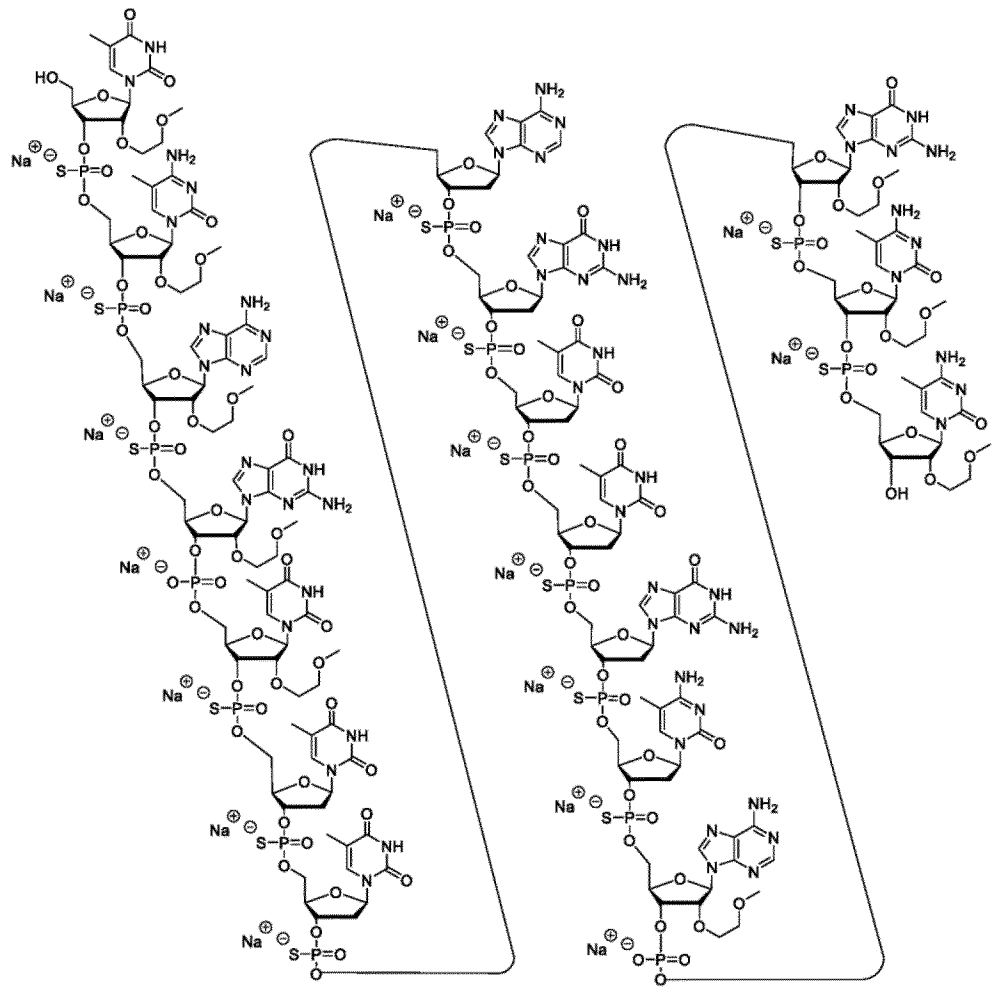

CERTIFICATE OF CORRECTION (continued)
U.S. Pat. No. 12,180,479 B2

In Columns 95-98, the structure should read:

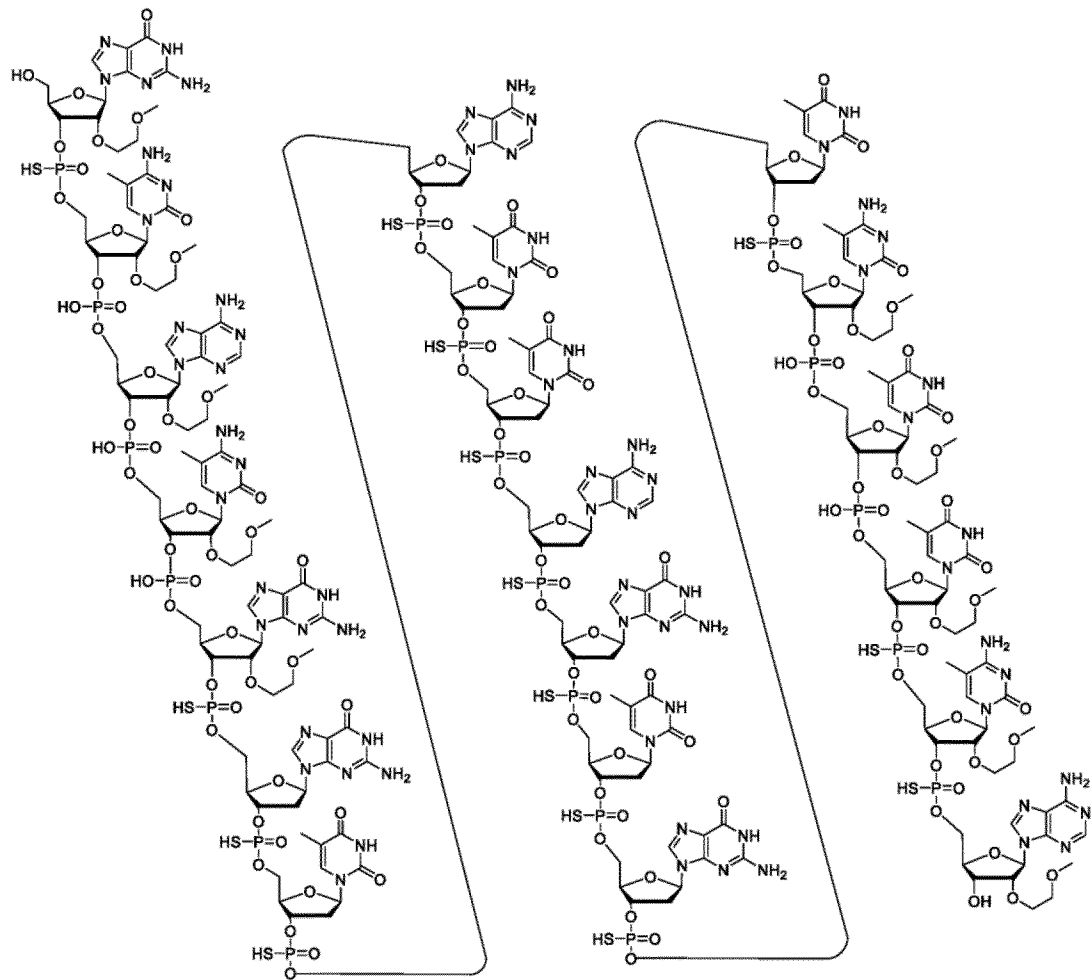

CERTIFICATE OF CORRECTION (continued)
U.S. Pat. No. 12,180,479 B2

In Columns 97-100, the structure should read:

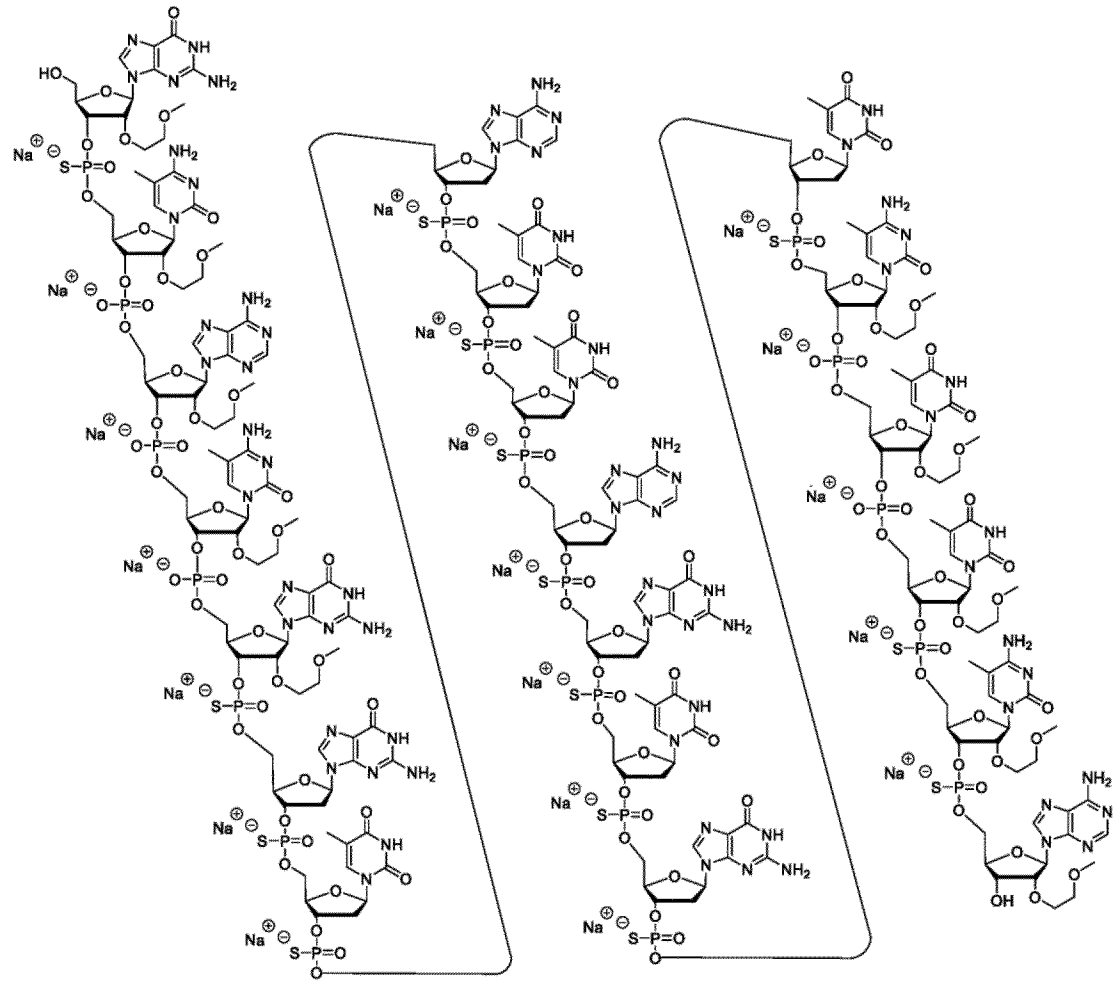

CERTIFICATE OF CORRECTION (continued)
U.S. Pat. No. 12,180,479 B2

In Columns 101-102, the structure should read:

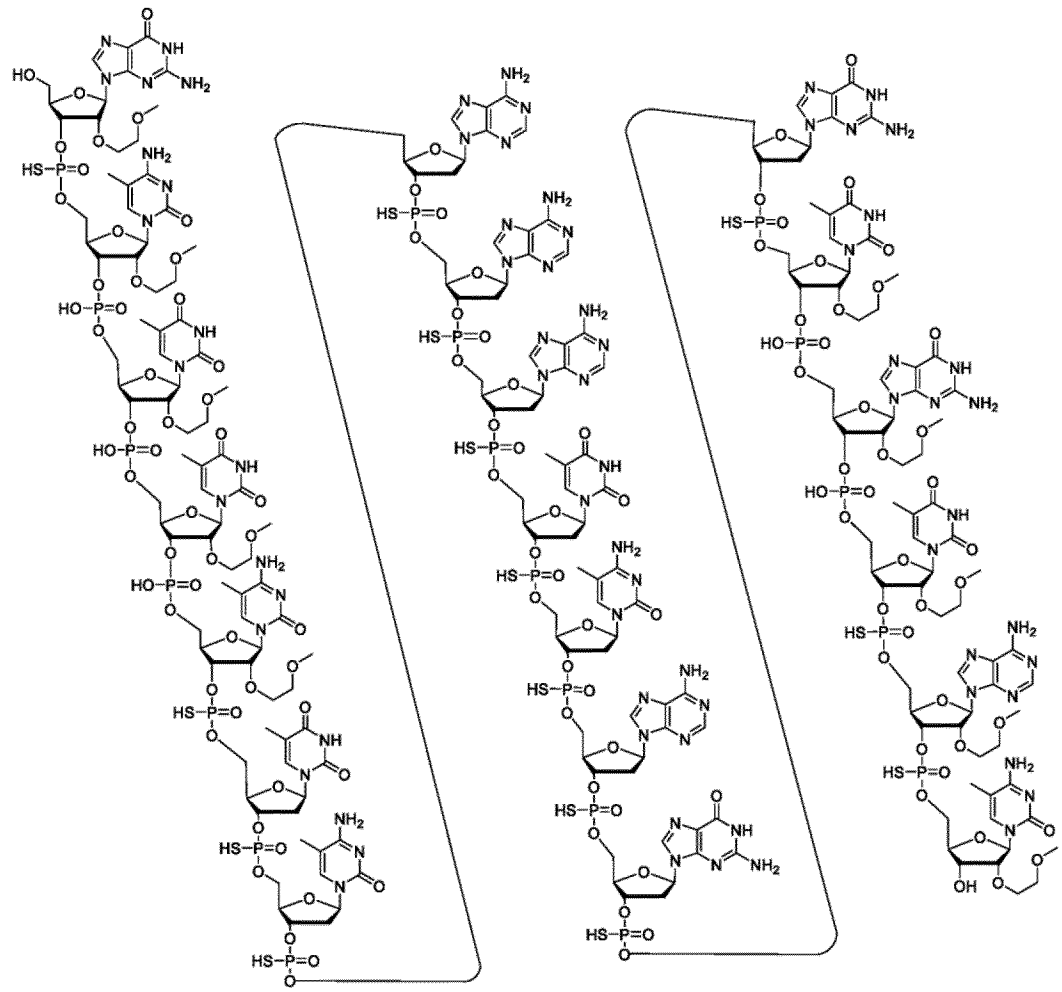

CERTIFICATE OF CORRECTION (continued)
U.S. Pat. No. 12,180,479 B2

In Columns 103-104, the structure should read:

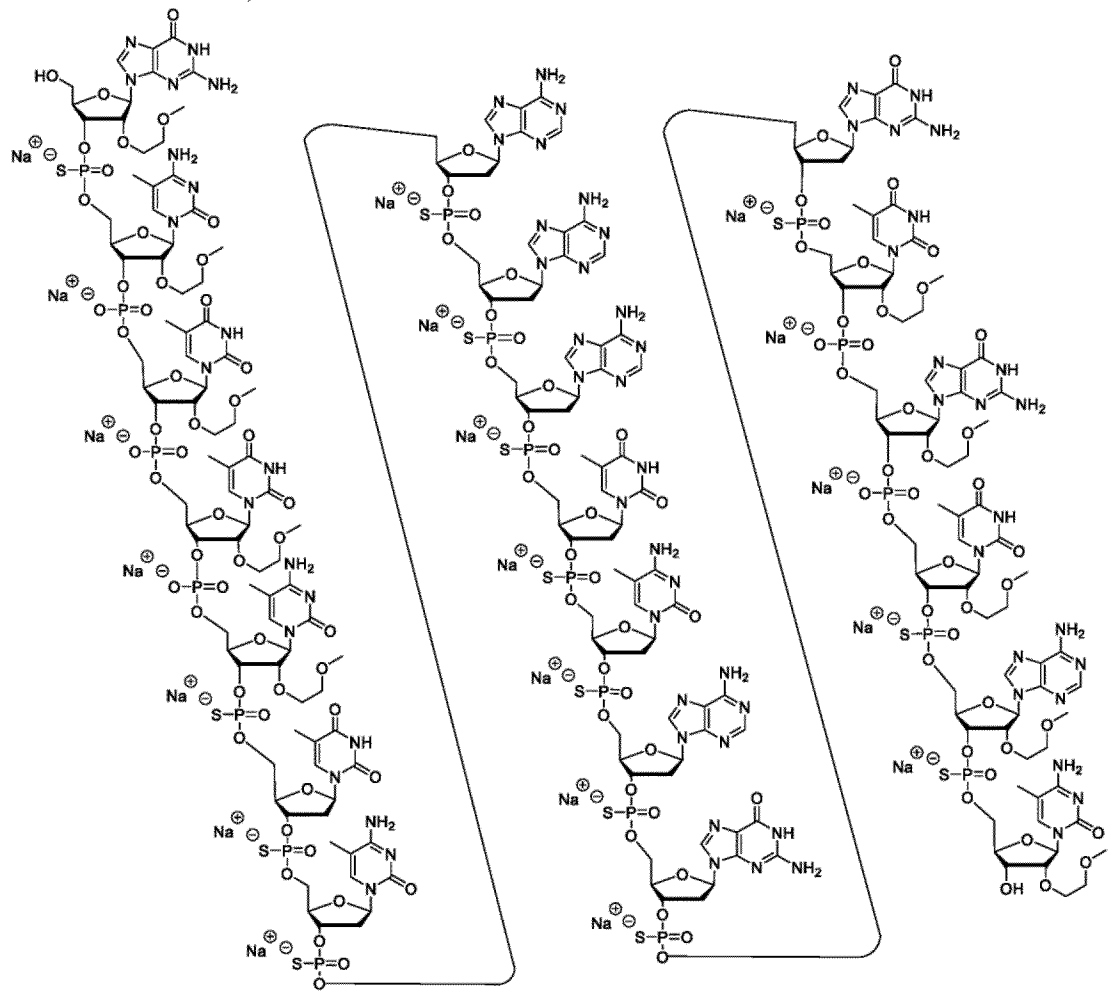

In Columns 105-106, the structure should read:
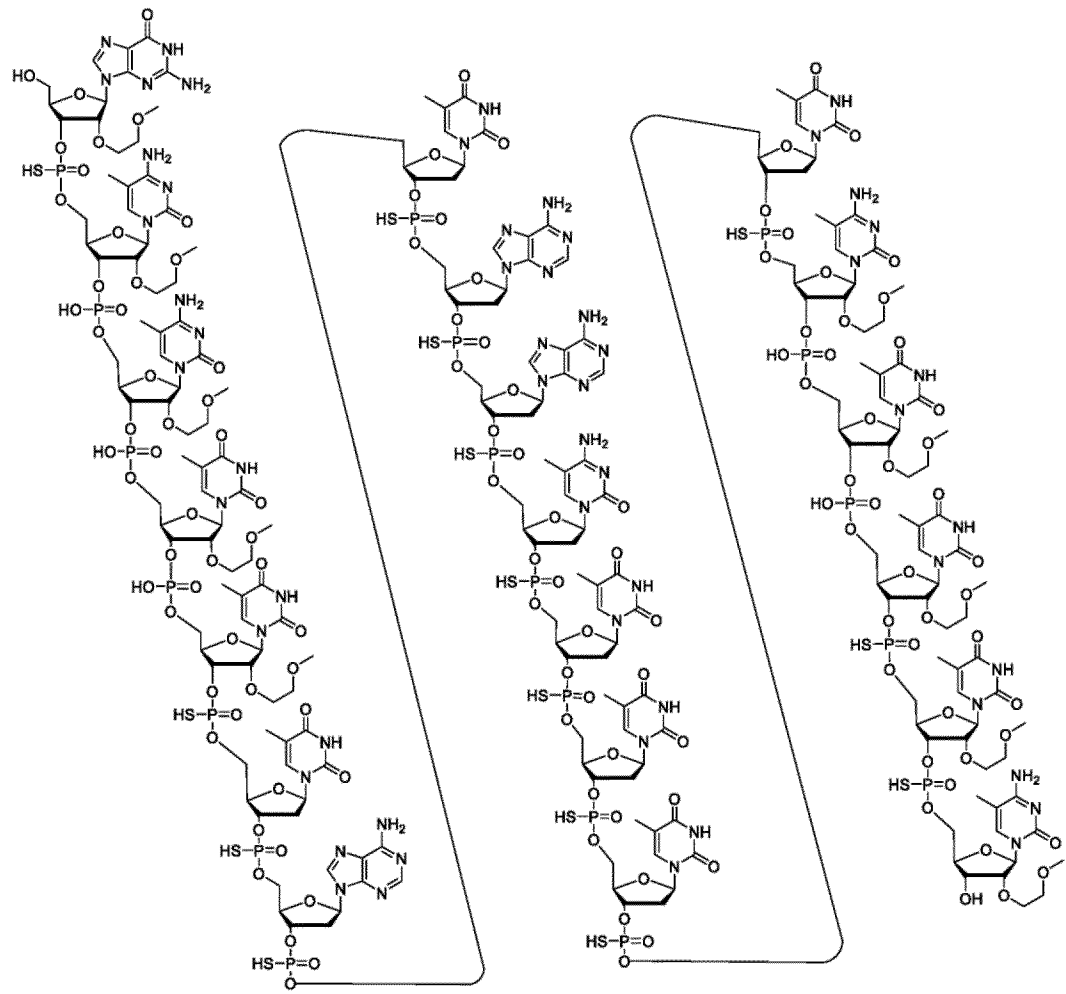

CERTIFICATE OF CORRECTION (continued)
U.S. Pat. No. 12,180,479 B2

In Columns 107-108, the structure should read:

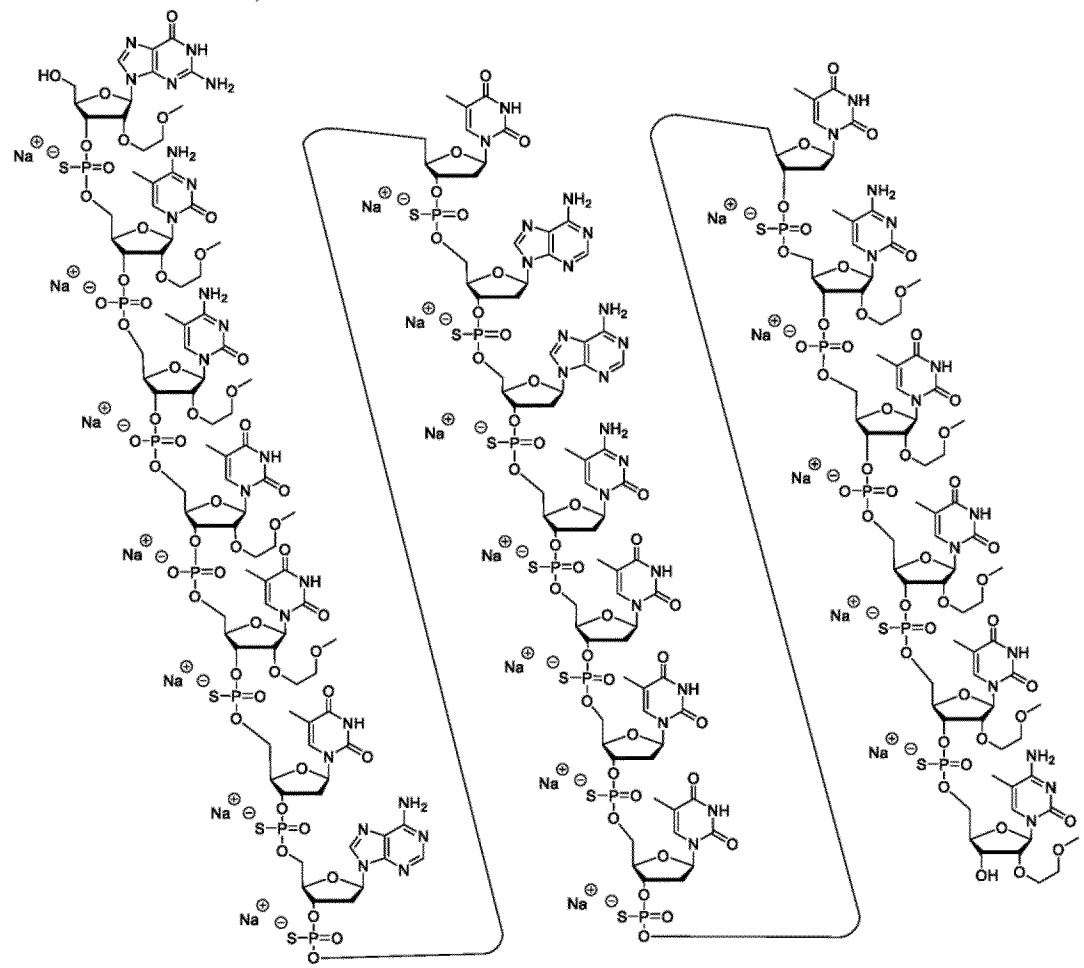

CERTIFICATE OF CORRECTION (continued)
U.S. Pat. No. 12,180,479 B2

In Columns 109-110, the structure should read:

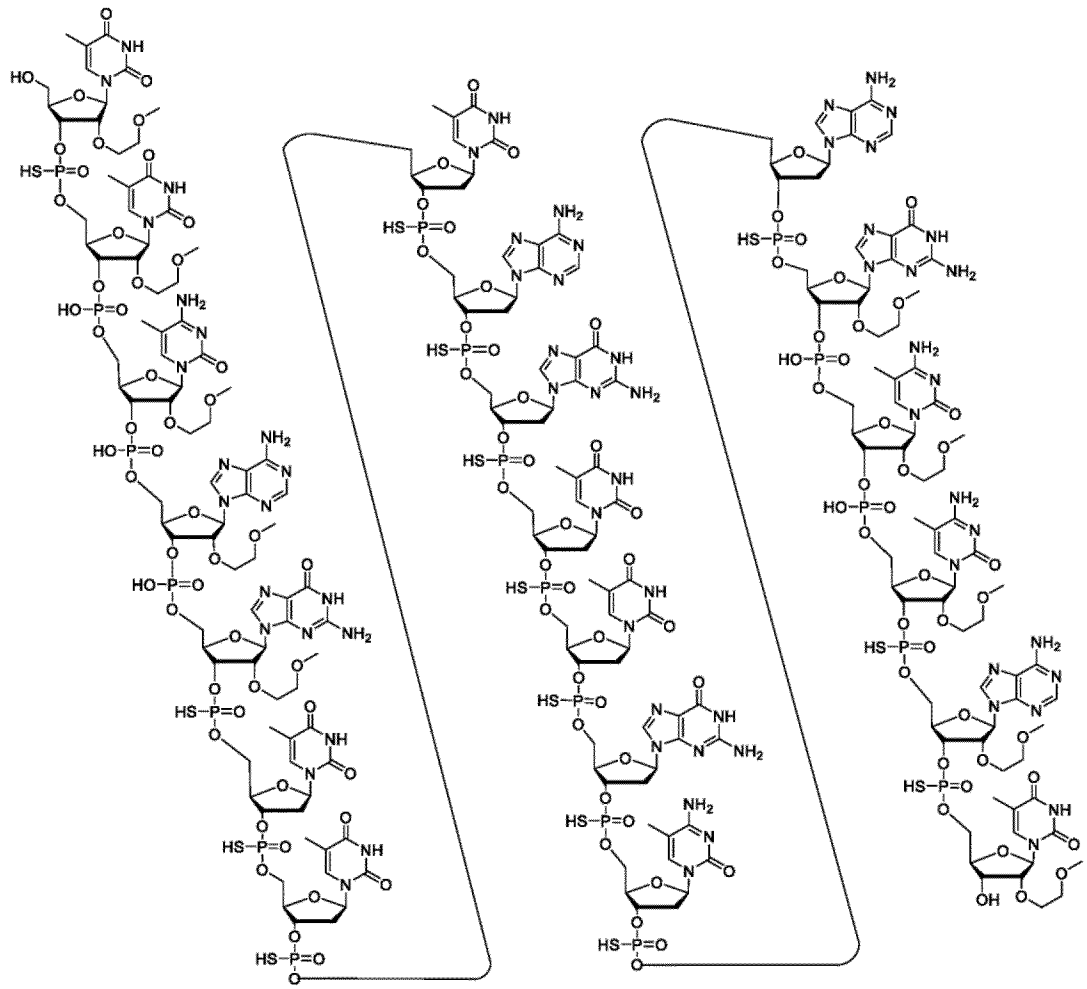

In Columns 111-112, the structure should read:
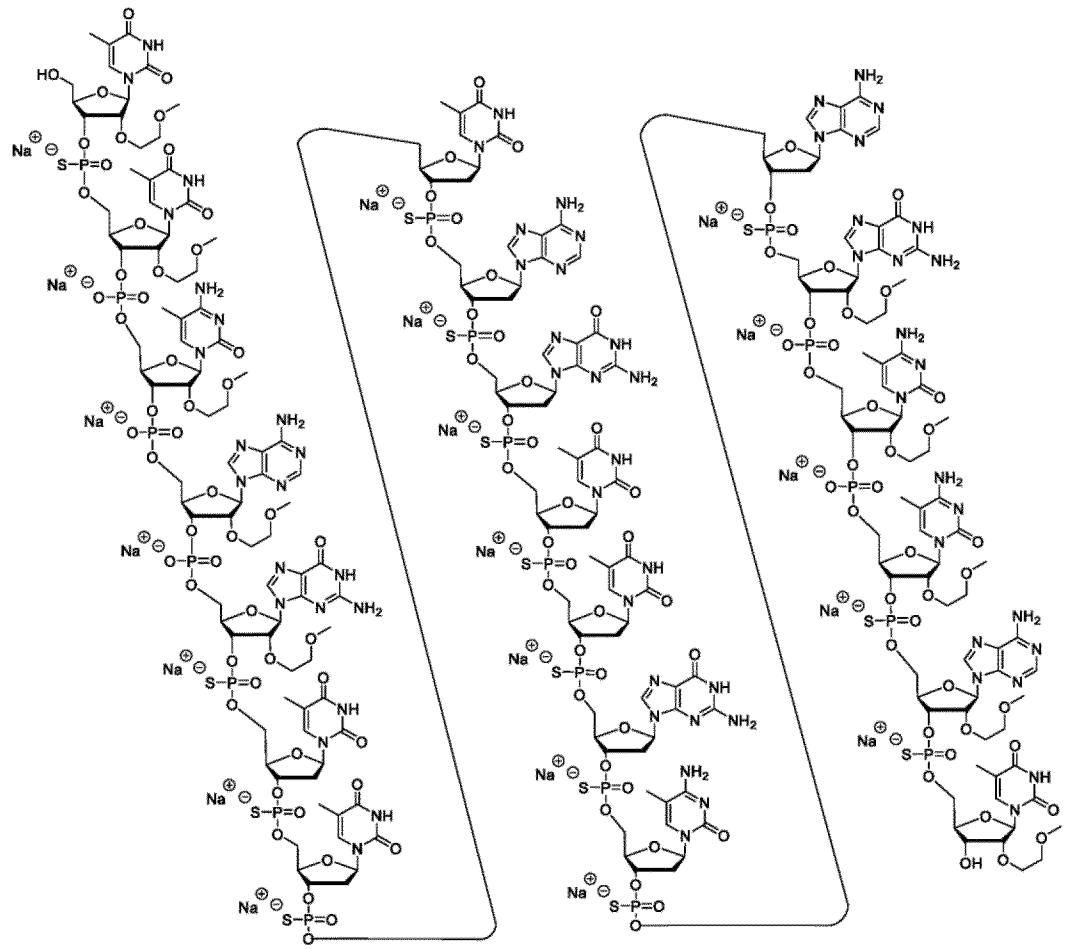

CERTIFICATE OF CORRECTION (continued)
U.S. Pat. No. 12,180,479 B2

In Columns 113-114, the structure should read:

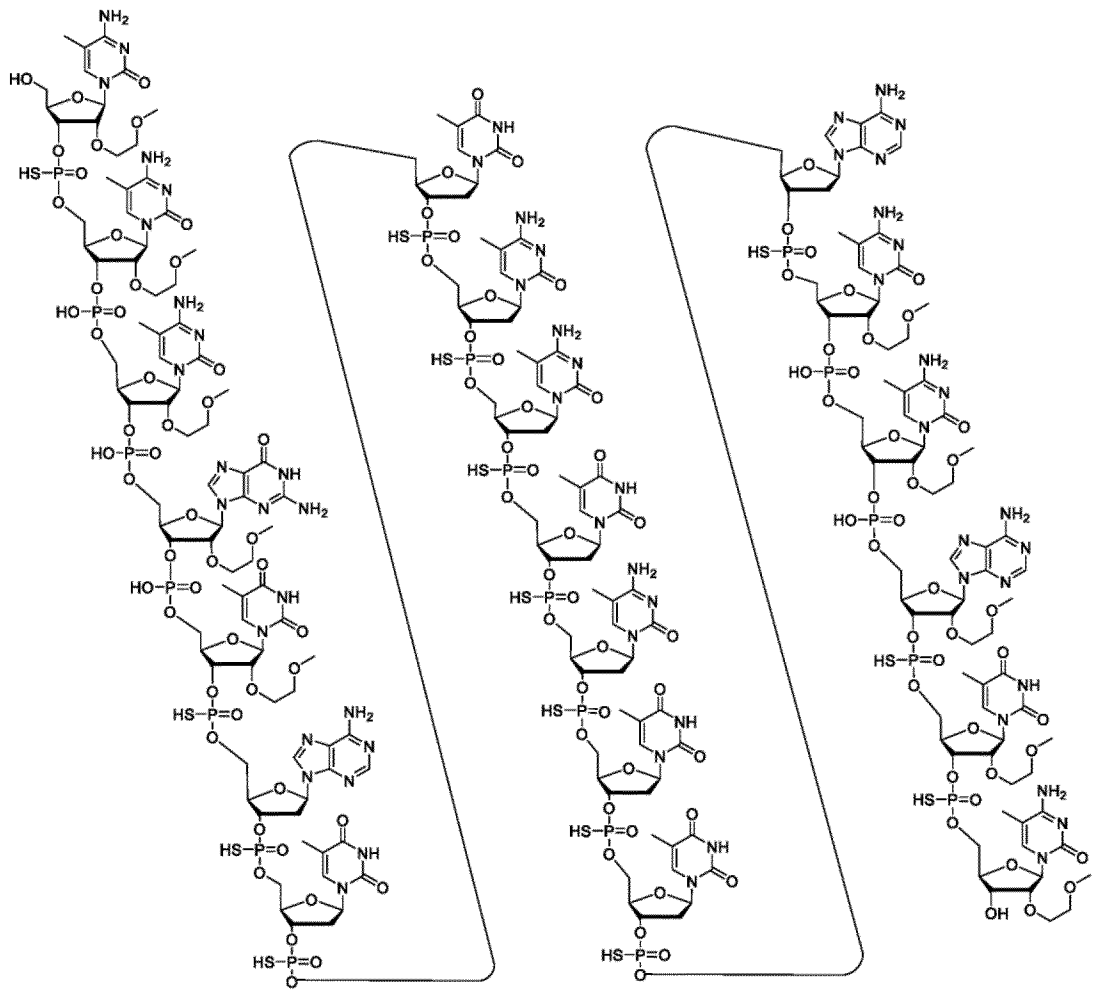

In Columns 115-116, the structure should read:
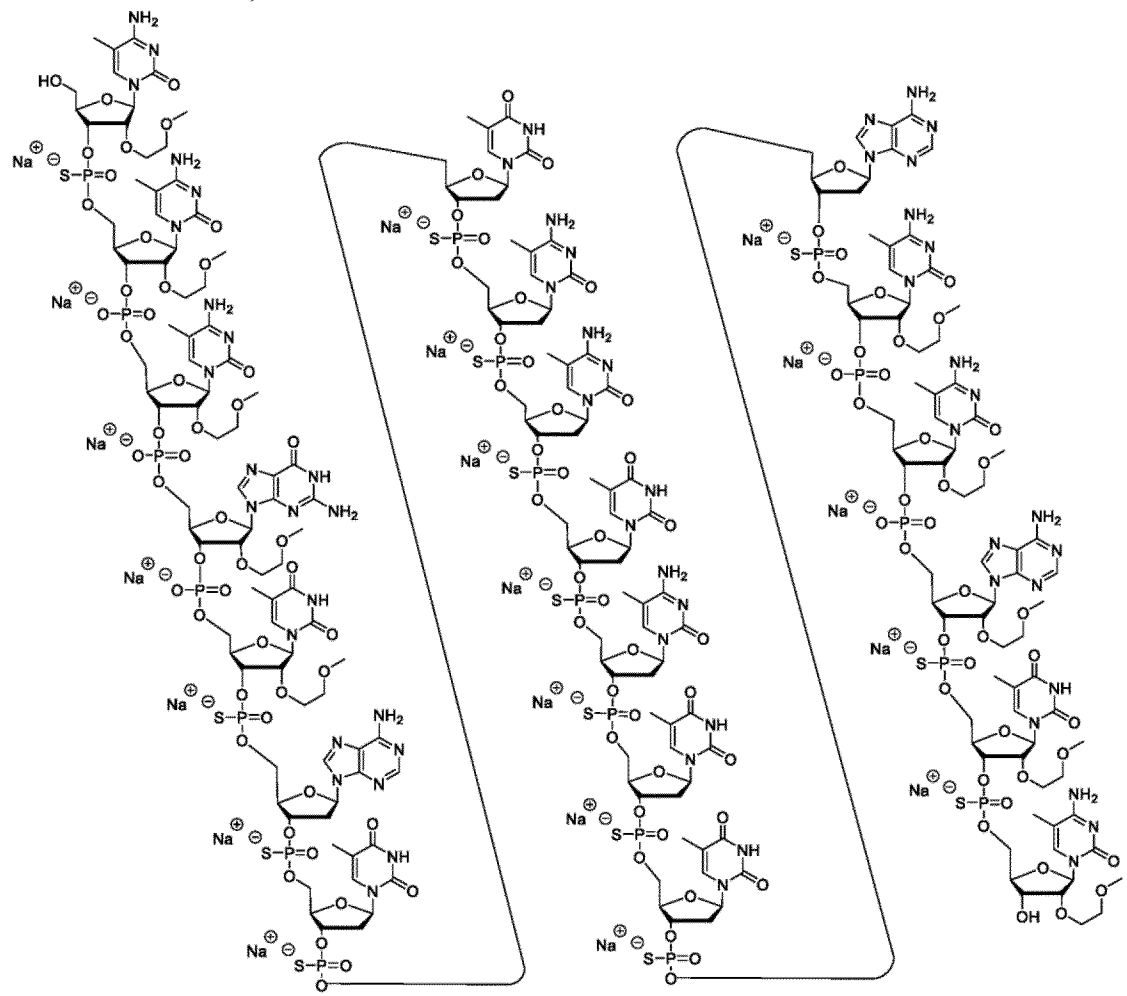

CERTIFICATE OF CORRECTION (continued)
U.S. Pat. No. 12,180,479 B2

In Columns 117-118, the structure should read:

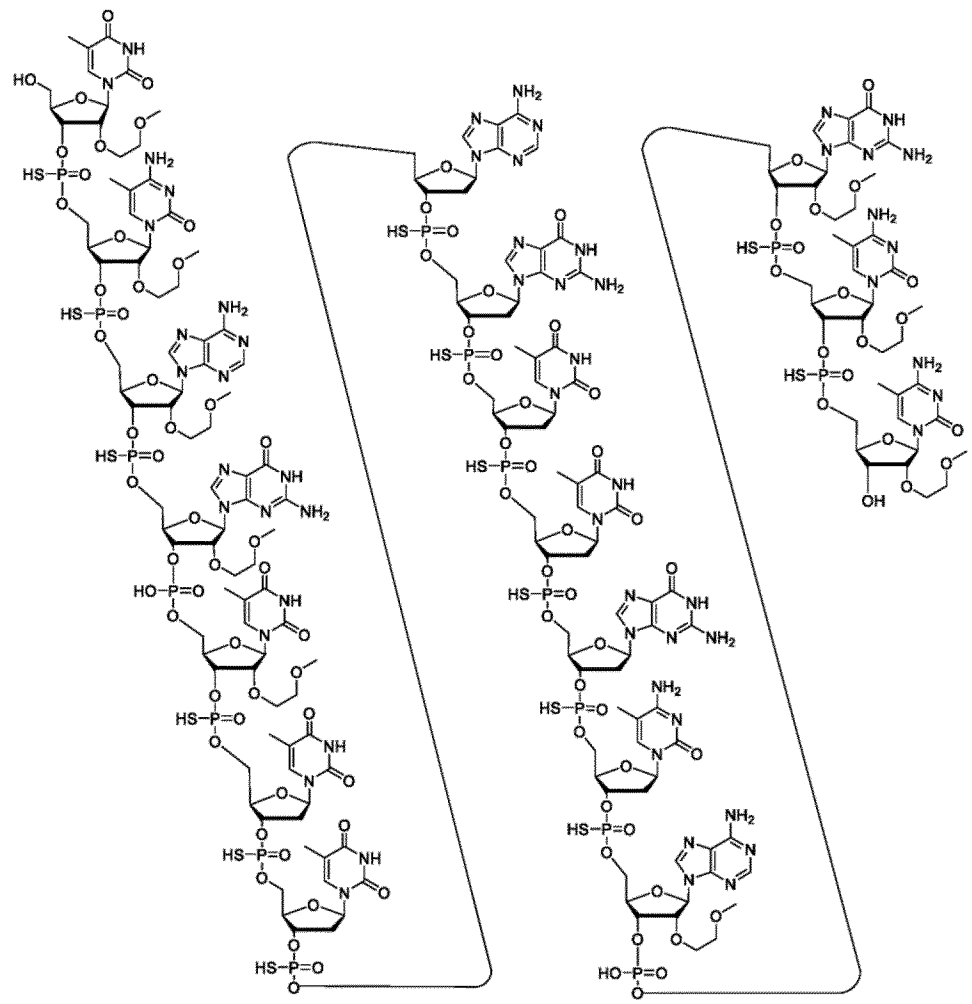

CERTIFICATE OF CORRECTION (continued)
U.S. Pat. No. 12,180,479 B2

In Columns 119-120, the structure should read:

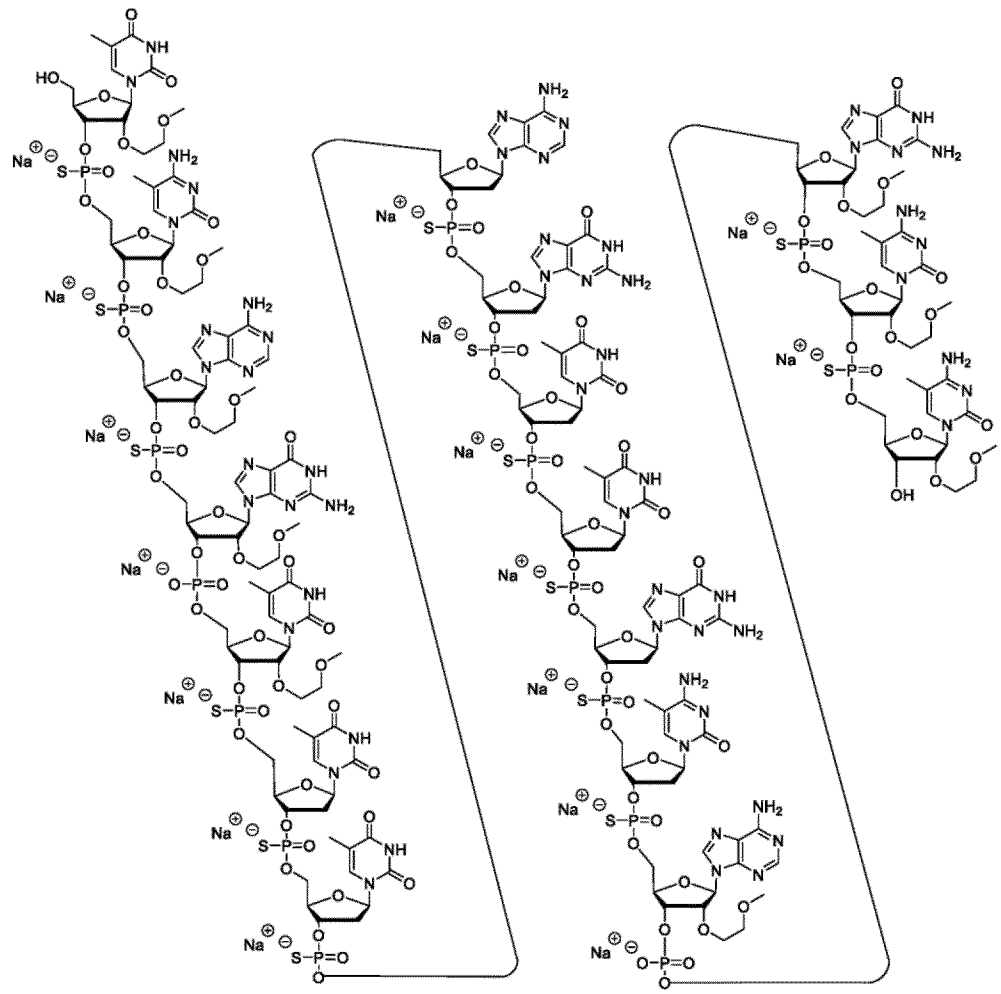

CERTIFICATE OF CORRECTION (continued)
U.S. Pat. No. 12,180,479 B2

In the Claims

In Claim 1, Columns 383-386, the structure should read:

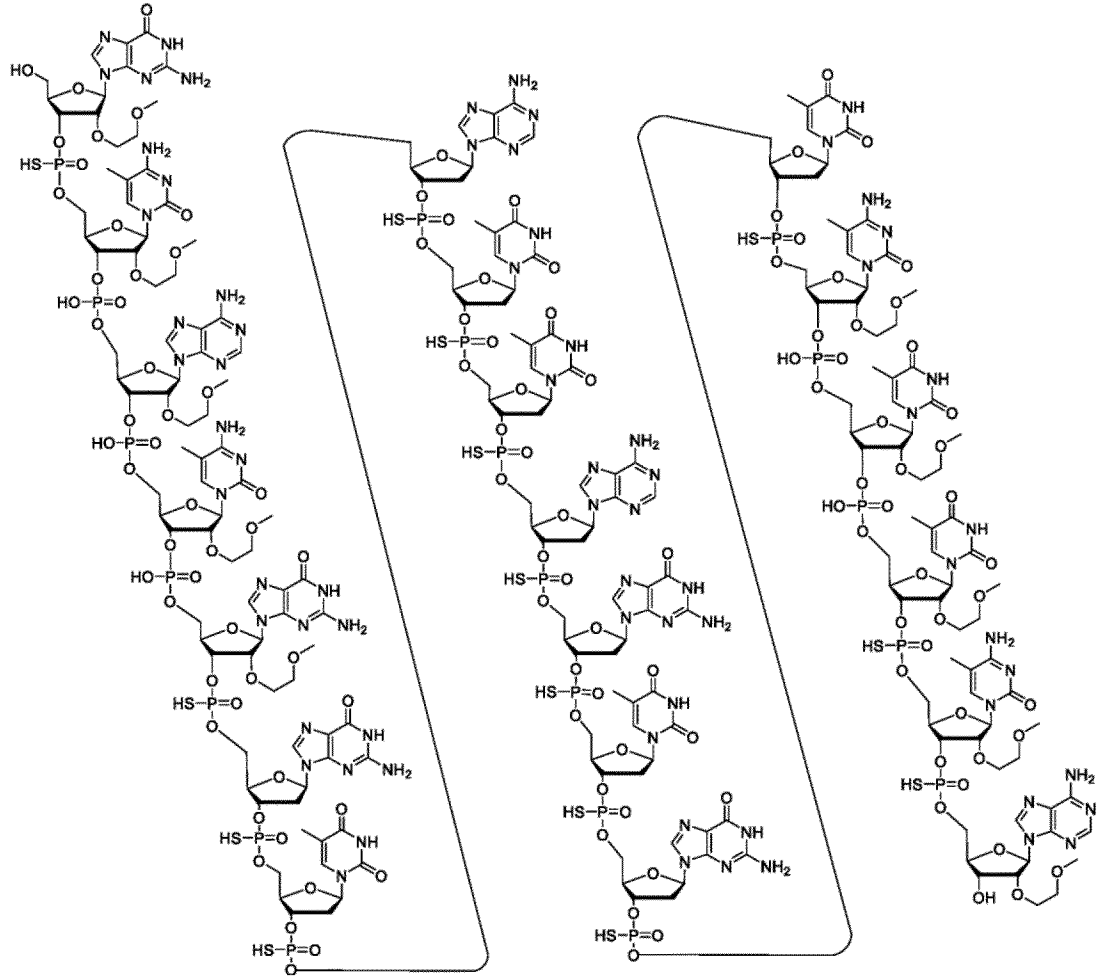

CERTIFICATE OF CORRECTION (continued)

In Claim 2, Columns 387-388, the structure should read: